United States Patent 9,976,180 (METHODS FOR DETECTING A GENETIC VARIATION IN SUBJECTS WITH PARKINSONISM) - sequence listing, part 7

SEQ ID NO: 72 - DNA, 18527786 bp, Homo sapiens (residues 6,175,930-8,234,572 of 18,527,786)
  misc_feature (4041202)..(4061201): n is a, c, g, or t
tcaccatgttggccaggatggtcttgaactcctggcctcaagtgatccacactccttggcctctcagagtgctgggattacaggtgtgagccattgcacccggcccatctcctgtttttcatttgttccataactgctgaaaatcaaccatctaccaagcaccaggtaagtcaagagacaggactcagatactgagacaggcgaagtggctcacacctgtaattccagcactttggaagactgagggaaaatcacttgaagccaggagttcaggaccagcctgggcaacatagcgagaccctgtctgtcccagctatttgggaggctgaggtgcgaggatcacttgagtacaggagttcaagctatgatcacgccactgcacactgcacctcagcctggacaacagagtgagatcctgtctctaaaaaaatacaataaaatattaaacaaaactcaagacactgtcctcaaggtcacaatagagagaggcaaagacaatcaagccagtaattgccacagggtgtgactagtgggggctgcagctgtggtttcaccaccaatcctgaggcagggactcacccctcatagaccctggtgaacgcctcatggaaccctgcactgagccttgcacagggagcactcactaataagacaccaagtgccaggaggcatttgaaagatggtgagaaggaggtgtgagaaagctccagagtttgaaagggacaggagcggaccctccaaacacggggaagcactttccgcgatttctttccctgcactatcaatgaccagggcacaggcagcccacgatcactttcgaatacaggtgcaaaaaagggcaggtgagcccacgtcagcgtgttagctgccagatctccagagggaggctcaccccccagggaagagaagggtacccaggaccctgagagccatcatcacttcacaggcagattccatctgtccccacccagagtccacaggaaaacagacttctggtaaaaatgcctcggctgtacattcagcccaccagttctgagtatctacacgtggacaggcaccgtgggttcaaaatcaagaaaaacagccaaggcctctgccctcagagagcctttgcagtttccctactttacagaaagtcaacctcaggggaatgaaggaacttagctagcatgtgaccccaagcgcagcccgtctcctaagtcacgctttgctctgcacccgctttgccagacagttctcagaactcagaactggctgagctcattgactgtcccctctactgcgtcccacagaagggtccttccccaaggtgcgcagaagcagcggcacttacccaggggcattctcaccccgcggacagtggaagcccctcagggggtgcagatcagagtgctgcaggagagagagggcgctggctggtgcgaagccgtccgaggtgcagcacagcccacaaggcctaggcaaggaaaaagcacggggagggggctttagtacaaggcccggggacagaagtccagactctgccccactggagtgctggcagcgtcttccatttaaaccacagctaactggtctgtaaaatgaaggttctaacacctacttttaaaagttattgaggggaaaacgagttaacggtctcaaggacgtggcacaatgactgacactttgtaggcaacagtcaagtggctttggaggcttccaatgccaggagtcgggggcgggcagctaaagtcgccgagccctgtttcccgccatccaggggcactaagcctccccgcagagtagctgcgcggacagggggtctgacgaccgcacgtggccggctcagcactgccgcggccaagggcgcgactcacccgccagtgtctttcccgaggacacgcgaatcctggggggctcactccggcaaagaggacgagacactgcaccaaggacagggcctgacctctctggccgccttccccggggcctcagtttcccccgatggtgagagtggagccgaccatgcgccctgctgtggactcacccggcgccctggcgtcgagtggcggcggagacctgacagacagcgtgggaaaaatcaagatgtctgcagatttcgagagatggggtgcggtggcgtgcgatggcgaaggacggcgagggacggcgaaggactgaggccacacgacaaggaagctacgctcgtttcgcgccggcggaaatacagacgagagcgcgagctgcggcctagagcggtaggaaccgacgcgagcagtcctgcagcgtcccctggcggagcggaggctcaacgccagactctggaggacttgggataattttcgaaaactatctggaagtttagaagtaaacttctcccacttgctttgcttttctgtttgttctgaagatgttccttggtcactgattcattattaatctgtaggaatggccaattttccatgataggagctgttactacgatgaggggactgtgcttagtttggacttctttctgcaagggtccaaaggcatctgtctttgattcaccactgtactcagtacctagttcagtgactagcacagttgaatgaatgaattctacccccgccccattcctttttttctgaacaatgtcagaccgagatgactgagtcatggcctgagactggaatgtgagcgtgagaagatgagccaagagagatgcacagcgggtaactgctttgctaaactccagcctcaaagtacacgggatggagggtggaaagagtctctgaagcagaagagacctgaccagactggcatctgaggaacctgatcagatttgcacagtgacagagactatagacagatgtcccatgttccctgcaacatactggagacaatcttgggaggggactcatggcccacaaatcctcataagcattggcactgcctgcaccctgggcagggtgtgcctcttcggcctgagacagccctgctactgactctgcccatgttctggagtgcaagcagcccacccttgggcctgatgaggagcccacgccccaccctccgccccgctccagtcagattcttggtactcaataggtcagaaggacaagaaaatccagtcctgatctatgcaaccatgagggaaatgggggtccctgaggtgagatctgctccatattttgtacctgggagaggcccatgggattcccagactgtgagaacactgggagtctctgtgatggggaggggctgtgggatgctgctatggtttggctgtgaccccacctaaatctcatctggaactgtacttcccataattcccacctgtcgtgggaggtaatggaatcatgggggtggttacccccatgctgcggttcttctgatagtgagtgagttctcatgagacctgatggttttataaggggctttacccacttttgctctatacttctccttgctgccaccatgtgaagaaagacatgtttgcttccacttccgccatgattgtaagtttcctgaggcctccacagccatgctgaactgtgagtcaattaaacctctttccttcatgaattacccagtctcaggcagttctttataacagtgtgaggatggactaatacagatgctgtggctgagaggacactgggcagggtggtcaggtgtgcccacttgtggccacacagccctggtgtcctcttctgcctcccactcttgctgttactctccatgtgactttggctaagtgacctaacttctccgccccgcctcagtttccagttatggaaaataggcagtcatagttccctgctcatagcgttgctgtgagaattaaatggaatgatttatatcaagaccgtagcacagaacaaatatccaaggcctagtagttgctatattatagtatttctgagaaagctgagggcttctgtcaccgtaaggactctgggattctttatgaagcagaggaaatgtgctgtgtttgaaaagtctaagatggcattgtcagcccggtgtgatggagcagtcctgtagtcccagctactcaggaggctgaggcaggagaatcacttgagcctgggaggttgaggctgcagtaagctgagatcacaccactgcattccaggttgacagaacgagaccctgtctcaaaaaagaaaaagaagaagaaagatagcattgtccaatagaaatataacacaaggccgggcatggtggctcacgcctgtaatcgcagcactttgggaggctgaggcaggtggatcacctgaggctgggagttccagaccagtctgaccaacatggagaaaccccgcctctactaaaaatacaaaattagtagggcatggtggcacatgcctgtaatcccagctacttgggaggctgaggcgggagaatcgcttgaacccgggaggcggaggttgcgttgagccgagatctcgccattgcactccagcctgggcaacaagagcgaaactccatctcaaaaaaaaaaaaaaaaaaagataaaaagtaaaagtaaaattaattttaataatttaactgaatataaccaaaatattatcatgtcagcatgtaatcaatattttataattattcatgagctatttactattctttttcttgtatgagatctttggaatctggtgtgtgatttacatttatggtacattacaattccgactggccacgtttccagtgctctgtagtcacatgtggctggttgctgctgtgctccccagcacagatataaggcaatctggctctcatcagccctttggagctggaagagacacagcaaacagtaggctgagtgcatccacaacccacacccacctccgccgccctacctatgagcctgaaagggcttggcctcctgcatattcagattgaggcctcaccaggctgaatcttctgggctggcaattaaggccaaggtgccctcagaaagctgggaacgggcagaactgcagattttctgtagttccagattttcttttgcactccttattctcataacactaaggagggcaccttggcgggttcattcctgcagccccagtgcctataggaggatggacacctaagaggagtggttcatgcttgttccacggtagtggaacaggatgttaaattagccgggcgtggtggcgggcgcctgtagtcccagctattcgggaggctgaggcaggagaatggtgtgaacccgggaagcagagcttacagtgagccaagatgacaccactgcactccagcctgggtgagagagcgagactccgtctcaaaaaacaaacaaaaaaaaggaagtttcagctgacaaatgacaaggtcaggagttcgagaccagcctggccaacatggtgaaaccccatctctactaaaaaatacaaaaattagccaggcatggtggtgggtgcctgtaatcccagctactcgggaggctgaggcacgagaatcacttgatcccaggaggcggaggttgcagtgagctgagatcacaccattgcactgtagcctgactgacaagagtgaaactccatcaagaaagaaaggaaggaaggaaggaaggaaggaaggaaggaaggaaggaaggaaggaaggaattgaaaatccaataaaattgctgttgtgataagcaaaaattgatttgagtattggcagtttttgaagtttccgtgataaaatagcagctgccttccaaagaaggtgctggaccaaatgcagaactgaggaaggagataaccgaaacatcgttgcttgtgactcttgaatcttctcttccaattggagggtagtaatggtacagtattagaaatgaaaaagaaggcgaatgatgaattgtatttcttatgaaaaagcaagagctgtgagtctcaccccctgcccccaaaagggagagacagggagggagcccgtgcatctcaccttaactcattaagaagcactttagcaggtcacaagggagcttgacatttgtcactcaaagttggggagcacaggtgactggggcccaacccactcctgagtcaaaggttcatagtctctttctgtaggagtagaatctgtggtatgaatgtctgcctgggacccaggaggtcccatccatgagggaacctgctagggtgagggaattccaagaagagggtctgtgcacacatcagtagggatgcaacaggcaacaggaggagtctctctgaagagcccatgagaaaggccacaagatcaacctctgagaagcctgggattgatagggaaggccacaagagaaataatcaggattaaacatctccctagcttggagagggcgcgggcttcttacaaaagcaacagacaagagacgtctccccgctccttaccctttactctacctgtttttatcctggaagtattgagagtgggtaagtggacagaaaattcctgttgaagagaaacatatctggatacatgaagagagaagccccacgtccctaccccagcctatcccgtacttagccccagctggtggagagaagtcttacctatggaagatcattgaaaacatagtaatgcgttagactgaacatttaaacttgttgaatggattcagcagatccttaactaatcctggtggggtttttttattcttttttgagacagattcttgctctgtcgcccaggcttgagtgcagtggtgtgatctcggcttactgcaacctccgcctcctgggttcaagtgattctcctgcctcagcctcccgggtagctgggattacaggcatgtgccaccacgcctggctaatttttgtatttttagtagagatggggtttcaccatgttggtcaggctggtctcaaactcctgacctcgtgatccacccaccttggcctcccaaagtgctgggattacaggcgtgagccaccacgcctagcctttttttttttttttttttttttgagactgagtctggctctgtcgcccaggctagagtgcagtggtgcgatctcggctcactgcaacctcccactcccaggttcaagcaattctcctgcctcagcctcctgagtagctgagattacaggcgtgcgccaccaagcccggctaatttttttgtatttctagtagagatgggatttcaccatatcggccaggctggtctcaaactccgaccttgtaatccacccgccttggcctcccaaagtgctaggattacaggcatgagccaccgtgcctgaccctactggtgtattattaaaaaataataaaataaaattgttgaatggaaactgtgttttccatttttagtgattgcaagactttttattacctaagaatgatcagagaaattctaaggcttttgccttatatttttctaggggcaggggagagacgctcccacttagcaagtctaagcagacatatcaggagtcctgctttcaacatactcgttgcaaaggattggactgtagctgggaagacaaggttccaccacaggaagtctgtgacctcatagtggctgagaaatccctggggcctggagccccttcaccagaagagatggaatcatggctggctggacagcttcttccaaggagttggtgcccggagtctaggtgggaagtcagcaactgaccatgcaaggcctgcaggagctccagacccatctccacaccaagagtgaccaccgtgctgcagattttgttgtatctgtccattctcctcctcggcttcttactgctcctctgttactgcgtctttcagtagcccatttgggtgatgagcactctctgggggtgctatgggggcatctttggagcttggcagcagtgtgctgtgatagaaaacaggtagatgggctgggcgaggtggctcacacctgtaatcccagcactgggggaggccaaggcaggcagatcacttgaggtcaggagtttgtgaccagcctgacaaacatggtgaaatcccatctctactaaaatagaaaaattagccgagcgtagtggtgggtgcctgtaatcccagctactcgggaagctgaggcatgagaatcgcttgaacccaggaggcagaggttatggcaagccgagattgtgtcacttcactccagcctgggcaatagagcgagactttgtctcaaaaaataaaataaaatgaataataaaagtaaattaaattaaaaatgaaaataataaaagtaaattaaatttaaaaataaaacaaaatataaaataaaataaaaatgatggagcatcagagacgcttgggtcccaatctcctctgccacaatctagctctgtgccctattctttttttttttttttttttttttttgagacagaatctcgctctgttgcccaggctggagtgtagtggtgcaatcttggctcactgcaagctctgcctcccgggttcacgccattctcctgcctcagcctcccgagtagctgggactacaggcgcccacgaccacgcccggctaatgtttttgtatttttagtagagacagggtttcaccatgttagccaggatggtcttgatctcgtgacctcgtgacccgcccatctcggcctcccaaagtgctgggattacaggcttgagccaccgcgtccagccactctgtgccctattcttaacctcaatttactcaccccaaaaacaaagctgtgagagaaaggaatttctactattgttgttgttattgttcttataactacaatcctgatcttttccaaagccaagatatttccctctcttttaccagaagtgtgttccctttaattccccagcaaggaaattttacagggtttggagaacagggtggccgttgctgggctctgtgctcactgggctgctctttcccatgctggccgttggcatctgcctcccgcgctgtctcatgctgtgctctctttctgtgtctgcatttgaaagtgatcatcagctagcctgtgtcttcgtcatcgatagtacaggccggtgaactgcgcaaagcattttctgcatttggagggtccatctctatccttggaaatgctagtgcttttctcacattcgacttctcttctgtgaacactctcaagcctctggggcattgtgggctgtcattttgtttggcctttctcagcttgacttcttggcaaaaattaggctgtgtatatctgggactatttgttgcccaggacaagattaactactcaagggatggctgaggctcacagagcatgagccctgcacagaagaggtaacatttcaccagccaggtgaactgtacggaaattaacaattgagtgtatgaatacatacaacattgagtatagatcgtgattatgataggatttaaagaaagatggcttcttggagatggtgtgctttggtggttttctgtttgtttgtttttgttttttgagacatggtcttgctctgttgcccaggctggaatgcagtggcacgatcagagctcactgcagcctcaacctgctgggctcaagcgatcctcctgcctcagcctcccaagtagctgggactacaagcacatgtcatcacacctggctaattaagaaaattttttttgtagagatgaggtctcactatgttgtccaggctggtctccaactcctgggctcaaacgatcctcccacctcaacctcccaaagtgctaagattgaaagtgtgagtcatcgtgcttggaccttggtgggtttttctttttttggagacaaggtcttgctatgcttctctggcctcaggggacccttctgccttagactccctggtagctgggactacaggtacacaccaatgcatctggctcttggtggatttttgaagtactcaaataggagtcctttaaagttgcaatgggaaggctcttaagggtcagggggagaaagaggaagactctgaagctgaagaggaggaagggatgggaagtggacacctgtgctggtatgtggataagttaggaaccggagggggcagtatccccccatctcattgcatggcctgtaatagatgatctttaaatgttgatgcaaaagaagaaagggaaatgctcattgtggcaacaggagagggctcacttaattctgaaatgtaagaaaaattacttgtgtcccagtctgctcttggctctgagggcttaaaaaaaatgaaaaaaggctgggcgtggtggctcatgcctgtaatcccagcactttgggaggctgaggcaggtggatcacttgaggtcaggagtttgagactagactggccaagatggtgaaaccccgtctctactaaaaatacaaaaattagccaggcatggtggtgggcgcctctcatcccagctacttgggaggctgaggcaggagaattgcttgaacccaggaggtggaggttgcagtgagcgcactactgaactttagcctggtcaacagagcaagactccatctcaaaaaaaaaaagaaagaaagaaaaagaaaaaaaagaaaaaagcaggacaacttaactgattcgaataaaataaaattagggccaggcatgatggctcacacctacaatctcagcactttgggaggctgaggcaggtggatcatttgaggttaggagttcaagaccagtctggccaacagggtgaaaccctgtctctactaaaaatacaaaaattatctgggtgtgatggcgtgtgcctgtaatcccagctaatcgggaggctgaggcaggagaattgcttgaactcgggagacggaggttgcagtgagctgagatcacaccactgcactccagcctgggtgacagagcgagactttgactcaaaaaacaaaacaaaacaaataaattaatgaaataacaaaagcagaaaacgagcatagggccaggcctggtggctcatgcctgtaatcccagcatgaaagtacatcaataggaaatgtatgtcagtgttgtggaacaacatctcaaaaacccttggaggatgttatggactgaatatgagaccaaggcaagaggatcgtttgagaccaggagttgaagaccagcctggacaacatagtatgaccccatctctacaaattttttttttttaattagcggggcctggtggcatgcgcctgtagtcccagctactcaggaggctgagacaggaggatcgcttgagcctaggaggtcaaggctgcagtgagccataattgcaccactgcactgcaagctggataacagagcaagaccctgtttcaaaaaaaaaaaaaaattggcaggcttcagttggaaagtcttggcctcagtgcccttgaagggcaggagtagtgcttctgccttgtgaatgccttctgaccccaccaatggggagaggtggacacgagagctgggcagatggaaatcagttgtatctttatcaatggtgacagctggatgtgaccacctgcaggctccctgacacctgctcctccttcctttacctctgttgcagcccaccctccaacccctaccacatacactgccatgctggatagtgcctgccgggtgagcttactcaggaaggagtggggactcagccaaggatcccatgaacaagcaaagcacagacaccctgaggggtgtgcagcctcaacaagtcctaacccacactcaagacaaattagatgagggacctcagagatgggtgactcctcccagagctccagaaagggtggaagtgcctatccttggcccagaaggtaattttgagaattgagagcttgagtgtgaaaggttgtaaaaatcaggccgggcacagtggctcacacctgtaatcccagcacgtgggaggccgatgtcaggcagatcacctgaggttgggagtttgagaccagcctggccaatatggtgcaatctactaaaaatacaaaaattagtcaggctgtggtgatgtgcgcctgtaatcccagctactcaggaggctgaggcaggagaatcccttgaacccgggaggcagaggttgcagtgagctgagatcacgccactgcactccagcctgggtgacagagcaagactctgtctcaaaaaaaaaaaaaaaaagtttgtggaattcagaatagcatttctcagaaagccccgctactgcttgcaaacctttttttctaatgaccgtgcacaggtttcactgtcacaggtttaattaaagtcttctgcttgatctcaagtagcgtggagaaaaaattcctcaaaagtgttgccattcagagatattttcaagggactttattagaaggaccatcatttaaggatgagatggtatgacagagggtgactctgctacaccagggaagaacatgctagggaaaacaccttctttcttttaagtcaagtgttttctgtgtcatcagattgcccaatcatccctggcatctctgcttctcaaccataggctatgatgtgtatggtgctcccatgagttgtgcagtacacgacctgcacaaccatatgtggcagtcctgcctaccctcaatggaagcaggatggagatgttcccctgggtaaacgtggcatatgtccctcactataagcaaaaaatcagagcaagtgtgaagtcagaagtccacccagagagagaggcagagttgcaggacagggatggaattccagttctggtgtttgttgtcttggaggcccagcttgacctctgcccttcccttcgcttgattatataagttttccaataatgtattttatttttaaagcgtaagttaggtttctatcaccaacacattctatctaaaagcccaagtcttttccttaacttgtcctaaatggccagttattaagaaattccattgagggtttggctgttgcatacagccttgtgggcattttgcttatccacgttgactttctcatctgggacactggcctacgtagtacgtgattccagcaaacagggcagtatgttgagctcttgaaataagtatgttgtgacagcctttgttacagcattaaaagaacagtctactctcaatggctgaccctttatttgtatgctgacgtcaaaaacaaaacaagactgcagacacactcttgccaatgctagaaaggatgcatgtttgaagtggatttttttctatttttttgcttggagaggagggtgtgtggacaccaagctggccatggtccaagctgacctatttgccagccgacccctgtctgggctgccataacaaagtgccatcatgaactgggtggcttataaacaacagaaatttatttctcacagttctggaggctaaaagtccaagatcaaaggcaccagtagatttggtaaactaggaagcggtgagggcccacttcctggtttatagactgatggctgtcttctcactgtgtcctcaaatggaagctgatgtttcacaaatattttctgggtaaatggatgggtgagtgaactcatgaagggatgctccattagatgaacgcttggataaagggcgttagtggagggacagaattgcagctccgtcctcccagggggcgctgcaggcacgtctgcttgggcaggggcccggcggaagcgccgctctaggctgcagccgcgcccccagccgtatttccgcgggcgctgagcactagagagagcgtcttgtggctgcggcctgcccctcagcctcctccgcgcggttacccctgtacccgccgccatccgtcctggcgctccggatgagtcaatgaggggcagggcccgaggagtggtcttcccaagaacccctggtggcctcccaaggccggtgctgtgtacctcctccccgacaaaaggggaaactgaggccccgaggggagtgggaagagccggctggacgtcaggcccagccgctggtgcagtggtccgtcccctctgccggggtgggcccctcgggtttcgcgtgtcctcgggaaagagactggcgggtgagccgcgccctcggccttcgctgggctaagccgaccccatgcagacgtcaaacccccctaggtcggcacagcctctctgcggggaggcttagtgcccccttgagaaacggcttggcaacgctgtgcccggggccttgcacgcgggctgagggggctagagacctcgcgacttttactcccccgaccccgatctccgactcctgactttggaagcccccaaagctgcttttcggttgcctacaaagtgtcggtcattgtgccacgtccttggaaccgtgaactcattttctcctcaataacctttaaaaagtagctgtaaaacctccattttacagaccagttggctgaggtttaaatggaggacgctcccagggccccagaggggcgaattccagactcctttgccaggaccttgtactaagccccttccctacgcttttccctgcctaggcctcgtgggctgtgcggctatcctggagacagatgacagctctcccttggatggctttgctggttccgcaccagccagcgcccccatttttcctgcagcaccctgatctgcactccctgaggggctcccactgtccgcggtgtgaggatgtccctgggtaagtggtgctggtcatgagcactttgggggacccttcaaattcccttctgggggaccccagcggagggcatggtcatgaattccgagaactgtatggcaaagccgggtgcagaggagagcctggctaagttctttcattctcctgagcttgactttctgtaatgtagggaaactgcgaaagctctgtaagtggggagatcttgcacgtttttcttgcttttgaacccatgatgtctggctacttgtagatactcaatatttgtgggatgaatgaacaatttaagccttttttttttttaaccagaaattggtcttctgtgactttcttgatgggggcagatgagatctttgtactgcattaagtggatagcgctcaggtcctttgggcttggcgctttggcaatctccaggcagctcactttggcctctgttcctggatcccctttgctcttttctgcgcctgcattcgtaagtgatcacgggctgcccgtgtcctggtcattggtagtgcaggcagaggaaatgcgggaaaggttgctgtgtttggagggtccacatcttcaccctcctgtcccaggagctttcctacactcctccttctcaaagctgcacacacctggggcctccaggggattgggggctgccgtgtgtgttatatcatgattagagctttcacttcctgctccctgctgttgggaaccaggctgtgtgtgttgcttaaattccccttgatgaccagcagagtcactgccactcagccatggcacactgctgtaaacctggttttgatctcctttcaatcttttgctgattaactacacattgatcagtgttggccaccctcaccctgccatagaccatccgctgtcttcctctgtagagttaactattttctcttttatgaggaaatagtgtgtttgcttaggagtgtttactgtctggtaactactgtgctaagccctttcctgttgcctgccatccctgctgcgagcagggacaagctgggtgctcactcatggcatcttatctgttgcagatagtccactgtgtgcagaggcatgggagttgtcatgttgggaacatgctagacctcagtatccttgaggtaagatctctggttcattctctggaatgttggttccttgtatctagtacagttctgtacatgttcccaggggctttggggttggtgtaggggagctgagaggtgagatgagaatggcactgtgggtccccagatccgctgtccacccagccaacccagatcacctctggcctttcctgtgccttccgggcttgctgctggggggaaacctccagagtcccactttggtaataagaggtctctgccctttctccctgggcagcaggatgttgtaatggaaaatgagtggacctaggcttcagagactctggtcccctggctttgaatccccttctgccactatcccagtcaaggactgattcagaacctaattttcttcatttggaaaataatgttctgatagaggtgacttttgtggtacttgagaccatatgattcctatcattaccaaccaatattttccgattgtttttgccccatgtgacttctctgtgattcctcctggcaaggaagttttacaggaaagcagggccacttttgggatcctgtgctgggctggatcattttcctggactggacctagtccacaagctgctggcatctgtttctcctcatggatctctctctgcccttgtatacacctgcattcaaaaatgatcacgggctgcctgtgctctggtcatcaataacgcagggagaggaattgctgaaagccgtttcccgtgtttggagggttcacacctgtccctttcaaatgctggcgctttcacacactccttctctcctgccagcaccttctggtctcaggagcattgcaggatgttgtgtgagtgagtgatgggagacactttagtatggcttttttcagcttagcctcctgttatcagagagcagtctctttcagtgtcaaggtttgagtactagatggtggagaaagcctgtgtgaattatttttaatgaataagtgtgatgatgggtggcatacagtcactgccttaagattttcaaagagaagcagccttttggaggtggtgggcctgggcaggtctttcaaggagtgggatgtgatgggcagtagaaaggtattccagggaggggtagcaacatgagaaggtctttcaaggattgggatgtgatgggcagtagaaaggtattccagggaggggtagcagcatgagaaggtctttgagtctgggatgagcaagagtgtctagtcccaccagggagacagatgtgtaggcaagtaatgacagcatggagggatggctgctggggtgatccttggctcccagcacggcgaggtggacatctatgggaggggccctgagaggtctcttgagctgtctttctgccagttgcacatctgctcagttgcctgttaagactcttaagacagttttgctggactcttaagtttttattttgatattctttgggagcattgagattcctttttgagatgagtttggtatgaaagaaactggcaactcatacctgattgattaactgggggcattcccattgacatcagcttgaagaaagacgacagaacactggagaccaagtacttacagccttctgctctgtggcccctcctcactccagggatgctgccttgggtctggaaactgttagaggaaaccccaagaggtgcaggcactgagcctctcaggacaatgacctggggtcccagctcccctggaggggcctcctcatggtaagtgaatgccaagaggttaagttggcctgtgtttccgaggtggaaattccaggtcgctggcttcatttgtcttctcttttagattgtttgggggttgatcacagaccaagagtgacgagtgatgtcaccctgtgactcatggctggaccttcttgcccctattgtctcagcacaacattattcgacttttccctcagcgtgggtgggcagaggaaaagccctgtggctctggggacttgggatccagagttgaagacccttcagctggctctgccctgccagtgccacagagtgccatggcccaggaagacaggttttcttccatctaggccaggccatccagtggccatcctccgtgtcctcccgcctcctcctggtgtgacttctgaaaaccaagaatttgttcctgttgactttttctgtgctatggaccattgtcctctcacccactcaataaatcttgaaacatgccctgctgcttgttctttcatttttgtgtgtttggtttttttttaatcagtatctccgtgtgccagcaagactgggtgtagagagtgggtcacaagggcaggtcttctggttctcactcattaagactttccccttgacacatacccaaggcttgacctagggaatgtgagatgggacgtgggatttggaccggggttgaacaataatcccaagtgcatctaggggtgggggggttcaggcttaggagagaaggggaactcttaggattaagttggcaggggaaacatttgagccaaggctttgggagagaagactatgacgggataacttagggatggaggcaggggctggagtccttgaagaatgcaagagtgccctgagctcaggtggtggattgcaggtgaatgtaggagttggttttgagcagaggagagagtggagtatatgaggaatagctgcacttggagagctctgggggtgtggcaggcagtgccagccgctggggcttctgttaccatgagatagatttggtctttggggattctctttggtagcagtgatcgcagtgatgtgcttacgtgtgcattgtatgtgtgtcaccacctccatatgttgctctgtcctcatttttcaggtaaatttcacacaagaatgctcccaaaggctatggtagaaagttgggagtcagttggtcccactccttcagttgaaatagaaatcactgtgactaagccgggcatggtggctcacgcctgtaatcccagcactttgggagtctgaggcgggtgaatcacttgaggtcaggagttcgagaccagcctggccaacatggtgaaaccccatctctactaaaaatacaaaaattaggcatggtggcaggcacctatattcccagctactcaggaggctgacgcaggagaatcatttgaacccgggaggtggaggttgcagtgagccaagattacgccactgcactccagcctaggcaacagagtgagactctgtctcaaaagaaaaaaaaaaaaaaagaaataactgtgactagggttgagggaaaccaggctgtcaggcatctctgatgacctctgccagcaggagacattcttggctgaagagtccgctctgccagccatctctggcgagggccttatttctgcattgcccccctccttattcctacccaagaaccacctgacacctctggtttgctctcttgaagatccccccacctgctgcaacccctctctagccggttttatccaactgtggcctttgtcctttagtgagaaatgaccacatttcccccaccaaagaaagggggccaaaattctccccttttctgagtccactatttttagtgaagttttacactggttggtgccttgaattggtagacctgtctttccttagcaaactgacccctctcatagctaagcaggttcctgtcagctaataggacaagtgtctacactacactcccttctttaatctctcgttctctttctctctctctcatgctcttcttgacccactacctcaatcctgcaacctgggggtcccttacgccctttttagtttgttctatgggaggcaacaatgatggagtactgaaaaacaagggaagaggtgagattgccacgcagtgggggaagagagtgtcagctatagagataggatcacttactgtggcttggccccctggcataaaagttttcttactaagccagactggttgatttgtggagggttccctcatttatcaccctattttcatgcatcctagtggttgctggctggatgtgaaggttggtgaactaatatgttagaagctcttagcatagcacttggcacataggaagtgctcgatgaaggatagctcctctcaatcactagaacttcctttccaattgtaaatggtcctcatcgctggcccagcctcttaggtctttcttctcctgccctctgccaccctcgcccgaccctaccctcagcctctagcctagacttcccattctcccgaggagacagcaaggccctcctcactctgcctgtggcctgcctgtccacccttttctcacacaagcaccctaggcctcagccacccttctgcttaaggtccctgaacatgttcttttcccggcctatgcgcctggaatgcatcctccgcttcaagctcagctgactcagcttgtgtcactttcttcaggaagcctttgctggcggaacctccacccagactggattccccgcccctccttccattcatatcaattatcagttctgtgcaggcacaattctaggaactggtaaacaaaacaggcaaaagagcaaatccctgctttgtacttacattttggaggacaaggacatatcataaaacaaagtactaaaataggtagaatgcttgagaaatgttaaggaaaaaaagtcataaagcagggaaacaagataggaagtttggggaccagcagagggagtggcattttaaattgagtagacacgacggcctccccaggaaggtgagatttgactaaagtgaggagctctcactgctgggcgttcactgcaggctgtttaagccgccatcactgcatggaccatggacaataggaagctttttcctggccgagcgtggtggctcacgcttgtaatcccagcactttgggaggctaaggcgggcggatcacgaggtcaggagatcgagaccatcctagctaacacggtgaaaccccatctctactaaaaatacaaaaaattagctgggcgtggtggtgggcgcctgtagtcccagctactcaggaggctgaggcgggagaatggcgtgaacccgggaggcggagcttgcagtgagccgagatcgccccactgcactccagcctgggcaacagagcgagactctgtctcaaaaaaaaaaaaaaaggaagcttttcctttggataccaggttcagtgaagtggggagacaacaggcatctgaggccactgcagtgctgcttctgattatgaacgtttcaccatgttgtgaaggtgcagctgaatcaagccaggattaactggtcagcacctggatgggtgtgtctagaggccaagctctgcacctgtcagctccccatccccctcacctccaaccatagctcagtggtctagggaagctcagtcacccaaggacagccttgataggcctaacccatcaccttggtccaggacccatagcagtgatcactgagccctgcagtgtttctgctgggagagttctgcatgtcaagagactgagtaattggttgcagaaacaggaagagacagagtaattaagtcttaacagcagcctaggagcatagaacattgagctcctgttgcaagtttctagaactcacaggtggagaatgaaatttcagtttccaaaccacgttcgtgctcctccaggcatgactgtgagcagtattctgatttgccatgaggcctggggattcagttttttctgaatttttataaggcatggctatgtgaccaagattccttttcgtttttttaaaaaattttttagtttattttttgagacagtcttgctctgtcacctaggctggagtgcagtggtgtgatcttggctcactgcaacctttgcctcctaggttcaagtgattcttctgcctcagcctcccgagtagctgggattacaggtgtgcaccaccacacccagctaatttttgtaattttagtagagacgaggtttctactaaacccccgtcacgttggccaggctggtctcaaactcctgacttcaagtgattctcctgcctcggcctcccaaagtgttgggatgacaggcgtgagtcaccatgcccagcctgtttttaattatttatttattttaagacagggttttactctgtcgcccagtctggagtgcagtggtgcaatctggactcactacagcttcaacttcttgggctcaagcaatcctcctgcctcagcctcatgagtaactggtactacaggtgtgcgccatcaggctgggctagtttttgtatttttttgtagagatggggttttacattgtttccctggctggtctcgaaatcctggtctcaagtgatcctcccaaattggcctcccaaagtggtggtgttacaggcatgagccaccacacatggcctctttttttttttttttttttttgagagcccttacattcactacttccattactaaagggagcaaaatgaatcttttctcattatagtcaaaaagcataccaacataatgcctgacgggtggaaggtgctcagtcaacatttagggatgaggaatgataccagcagatgccttgatagtgtgcgccagaaatgactcatgcaggcccctctgcctctgtgggtacgactgataataggtgggcctggtgaagtcactaagaatctgatgtggctgggcaaggtggctcgtacttggaatcccagctacccaggaggctgaggtggaaggatcacttgagtccaggagtttgagaccaacctgggcaatacagtgagaccctgtctcaaacaaacaaacaaaaacacacgaaaacctgatgctgtcacttaattgctatggggcctggagcacattattttgcctccctgaccctcagcttctggctgtctaatttgaccatcaacatagcacttaccccaaatagcaatgatgaagatgatgcatgttaaatgcgtaacatagtaactgccttgcacggagtgcttgataaatgtctgctgtttttatttgatgagcacatatagcttgttgatagttaaaatgaagaacaaatataaaatgtcattatgacaggctcatctgctaaggcaccacaaatactttcttctttcttgtttgctaatttgcagacatcccagcggggttggtgttagtcactgctaccattgattgaaattctgttaagtcccacgcactgtattaagcctgtatgtataattacctcacttaatcttcacaacaacccagtgaggtagatttaattattttccattttacaaataaggaaaccaaggctcaaagaaatggaagagacctgtctcacacctaatgagtggctcagctagttttccatttcctgctgtattaaatagtgaaaaatgtttcaggctgactgatttcataaatagcataagcataccaagcttatcagatgcttgtttgtactggaatactggaaattaggatattttactatttgttccatctgcttcaaattattgcctattatttagagttgctgaaatagtcttcatctaaatcagtggttttgcagattgaacttatgaacctgacatgtacagggacaatagccatgttttagccaacaccaaaatatcaagtgtccttcccactactgttgtgtctgaagcaagagtcatccaagacccacagaacttgaggaaacttgagaagggtatcaccaatgtggcccaataaccaggattagcatcaagaagagccacgatcctaccaggaaactgttgcctggcaccagagtccctgtgacacagtgggtgggagattccacggcagaattgagccaggagaatgaagaactggacagaatgaaggttcatttgtccatccaaaagatatttattaggcactgtgctgggaatagagataccatgatgaacaagaaagttgttgccctcaagaggatcgcataaacgtgtatagatgataagttatatgaattcacactccagatacttatggaacaatcactatgtgctgggccttgctctcagatgggcatttgggtctgaacaaagcaaatgaaggagtttatagtataggacaatgctgtccagttaaaaaaataatgtgagccacatatataaaatttcatagtaacctcattaaataaaaagcaggtgaaataaattttggtaatatttatatattttatttagcccattacatcaaagaatgttgttatttcaacacgtaattaatattaaaaattatcattattattattttgagacagagtctcgctctgtcacccaggctggagtgcagtggtgtgatcttggctcactgcaacctctgcctcctgggttcaagtgatccttccacctcagtttcccaagtagctggtattacaggcatgtgccaccttaccctaatttctgtatttttagtagagatggggttttgccatgtttgccaggcgggtctcgaactcctggcctcaaatgatccacccgccttggcctcccaaagtgctgagactacaggcatgagctaccttgcccagccaatattaaaagttattaataagatttttccccaaatgaaatctttgaaatctggtatatattttatacatacagcacatctcagtttagactagccacatttagagtgctcagtagccacatatggcgagtagctatcttactggacatcatagatttagacaataaggggttcaaggatgcctcctttacaggaaggctgctgcatcttgtgggggcttaatgaagctgctccagcttggatcccccattctctggtatcccctctcctccatcttggcagagcagggcgaggtatatatcaggcatgcctgatggaatcctgcctcatgttccagagccttctggaggcaagacaccgagtcctgggtgtgcttctctaacacagatcctactggagttaactttagtgtacccagcgtttgttattcagtcagtcactacctgtttactaagtgctggcctctgtgctaagcactgtgaatgcacgccagtgaaaacagacatttgttagctcataatttcatcaagataaacaagatgcataaattgttaaaaactctgagaaattctacagaggaagagggaaaggtgctgcaagagtaaatagggcacctgacctcttgggagtcagggaagtagacttaactgagcaaaggaggagagtggtccacatccaaaagctgcgtggaggatgcagggaggagctcaacggtggttggtgtggctggcatgcagcccggagtggtgtgagcactggctttggagtcacagatctggtccaacttaactgggtgactttgatgacaagttttaaactctgtgcgcctcagtgacctcctatagagggatgtggtgaagattaaacagattgatgtttgtttttttaagacggagtcttgctctgttacccaggctggattgcagtggtgcaatctccactcactgcaacctccacttcccgggttcaagctattctcctgcctcagcctcccgagtagctgagattacaggcgtgcaccaccacacctggctaatttttgtatttttagtagagacggggtttcgccatgtttcaccagagtggtctcaaactcccgaactcgtgatccgctagtcttggcctcccaaagtgctgagattacaggcatgagccaccacgccctgccatgagcagctattttttttttacataaaacttttattttggaataacttcagatttacagaaaaatttaaaacctggtacatagagttcccatatgcccttcacccagcttcccctaatattagcatcttatgtaaccatgacacatttgtcaaaattaaggaattaacactgatacattaccattaactgaaccacagactctatctggatttcgccagttttcccattgatgtccattttctctgccatgcagaatagcacattacatttagttatgtatccttaatctcctccatctggaatggtttctcagtcttcctttgtttttcatgaccttgacagttttaaagtgttggtaagatattttgtagaatgtctctcaatttggatttttctttttctttttcttttttttgagatggagtcttgctctgttgcccagactggtgtgcagtggcacaatctcagttcactgcagcctccatttctcaggttcaaacgatactcatgctttagcctgccgagtagctgagactacaggtgcgtgccaccatgcccggctaatttttgtattttgttttgtttttttgagatggagtctccctctgtcatgcagactggagtgcagtggcgggatctcagctcactgcagcctctgcctcctgagttccagtgattctcctgtctcagccccctgggtagctgggattacagacgtgcgccaccatacctggctaatttttgtatttttggtaaagatgggccttcacatgttggccaggttggtcttgaactcctgacctcaggtgatccacccgcctcggcctcccaagtgctaagactgcaggtgtgagccacctcacccggcctaatttttgtatttttaatagagacggggtttcaccatgttggccaggctggtctcatactcctggcctcagggatcttcccaccttggccttccaaagtgctgggattacaggcatgagccactacacccggccctcaatttaggtgttcctaacattttctcatgattagactggaggctacgggtttctgggaagaatactccagaggtgaaatgcccttctcatcacatcatatggggggtacattatatcaatgtgactcatgatcagtgacattaaccttgatcacttggttaaggtggtgactgccagacttctttgctgtgaaattcttatttttcccttttcgtaccgtaatatttggaacataggtttgattttaatagatattttaaaaatatatatttagaaatctttacccacactgagagaatgtatatatttttctcaagcacctttggggtatgtattaatattgtttgcatatttacaatatttacaaatatcatctacagcatagaatgtggtaactttgatgctgcaaagcaagtctcaaatattaataccagcacatcagtatcaggaataaatgggctgggcgtggtggctcacgcctttaatgccagcactttgggaggctgagtcgggtggatcacctgaggtcaggagtttgagaccagcctggccaacatggtaaaaccctgtctctactaaaattataaaaatcttccaggcatggtggcgcgtgcctgtagtcccagctcctcaggaggctgaggcgggagaatcacttgaacccgggagatgaaggttgcagtaagctgagatcttgccactgcactctagcctgggcaacagagcaagactctatctcaaaaaaaaaaaaaaaaaaaaggaaagatgacgactgcaatatgtcactacaatgtaaagtctaaataaaaacaaaacaaatgttaaaaatactcagacctgaagggtaatgaaaatactgtattatcaaaacttgtatgatgtatagctaaaacagtacataggagaaatttatagcctcaaatgctttcattgggaaagaacttcccaccagtaagggagtgtgtgactcattacacaggttagacggaagttcagagagttctccctggtgtctttggcatttctccaggatttttgcagcactccgagggaatcagagccccagtaactactgagattgaatgagccactagtgcagtacaatgcagacacagaacagattatattttattccacaaagaaaaggaatgagatcttttcccaccttacctttgtgaaatatgttccatttccattggaggtgctgaaggaaatcaggttttaagtcatgttttatttagatctgctagagagactgtgttttgtttttctttttttttttttttaattgatcattcttgggtgtttctcgcagagggggatttggcagggtcataggacaatagtggagggaaggtcagcagataaacaagtgaacaaaggtctctggttttcctaggcagagtgtttgtgtccctgggtacttgagattagggagtggtgatgactcttaaccagcatgctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacttctttctacacagacacagcaaccatccgatttctcaatcttttccccacctttcccccttttctattccacaaaaccgccattgtcatcatggcccgttctcaatgagctgttgggtacacctcccagacggggtggtggccgggcagaggggctcctcacttcccagtaggggcggccgggcagaggtgcccctcacctcccggacggggcggctggccgggcagggggctgaccccccacctctctcccagacggggcggctggccgggcggggggctgacccccccacctccctcccagacggggcggctcgcctggcggggggctgacccccccacctccctcccggacggggcggggagctgacccccccacctccctcccggacggggcggctggccgggcggggggctgacccccccacctccctcccggacggggcggctggccgggcggggggctgactcccccacctccctcccggacggggcggctggccgggcagaggggctcctcacttcccagtaggggcggccgggcagaggcgcccctctcctcccagacggggcggctggccgggcggggggctgaccccccacctccctcccggactgggcagctggcctggcgggggctgacccccacctccctcccggacagggtggctgccgggcggagacgctcctcccttcccagacggggtggcagcagggcggaggggctcctcacttctcagacggggcggttgccaggcggagggtctcctcacttctcagacagggcagccgggcagagacgctcctcacctcccggacagggtcgcggccgggccgaggcgctcctcacatcccagacggggcagcggggcagaggtgctccccacatctcagacgatgggtggccgggcagagacactcctcacttcctagatgggatggcggccgggaagaggcgctcctcacttcctaggtgtgatggcggccgggcagagacgctcctcactttccagactgggcagccaggcagaggggctcctcacatcccagacgatgggcggccaggcagagacactcctcacttcccagacggggtagcggccaggcagaggctgcaatctcggcactttggggggccaaggcaggcggctgggaagtggaggttgtagcgagccgagatcacgccactgcactccagcctgggcaccattgagcactgagttaacgagactccgtctgcaatcccggcacctcgggaggccgaggctggcggatcactcgcggttaggagctggagaccagcccggccaacacagcgaaaccccgtctccaccaaaaaaatacgaaaaccacgcaggcgtggcggcgcgcgcctgcaatcgcaggcactcggcaggctgaggcaggagaatcaggcagggaggttgcagtgagccgagatggcagcagtacagtccagcttcggcttggcatcagagggagaccgtggaaagagagggagagggagaccgtggggagaggggagagggagagggagaccgtggaaagaggggagagggagagggagagggagaccgtggaaagaggggagagggagaggggagctttttttttttctttctttggttggctgattttgagacagagtctcctctgtcgccgaggctggagtgctgtggtgcaatcacaactcactgcagcctcaacctccactcagcaatcctcccgcttcagcctcccaagtagctgggatcacaggcacatgccaccatgcccagccaagggtttcaccatgttacctaggctgatcttgaattcctgggctcaagtgttagactcacttcggcctcccaaagtgttgggattacaggcgtgagccactgcacccagcctgttttgtttggggcaagggttttaacatttatatatatataaatatatatatattttatatatacaaatatatatataaatatatatttatatatatttatatataatatattatatataaatatatttatatataatatattatatataaatatattatatataaaatattatatataaatatatatatttatatatataaatatatataaatatatatatatataaaaataccagcacatcagtatcaggaataaatgggctgggcagtatatatatatatatatatgtatatatatatactgtttttcatatatatatactgtcttatatatatatatactgttttacatatatatactgtttcatatatataatgttttatatatatactgttatatatattatatgtactgttatatattttttatatatatactgttatatatattttttatatatactgttatatattatatatatactgttatatatatattttacatatatactgttatatatatattttatatatatatactgttatatatatatattttatatatgtatactgttatatatttatattttttatatgtatactgttatatatatattatatgtatactgttatatatatattttatatgtatactgttatatatatatatttcatatatatatactgttatatatattttatatatatatactgtcatatatatattttatatatatactgtcatatatatattttatatatatatactgtcatatatatattttatatatatatatactgtcatatatatattttatatatatatactgtcatatatattttatatatatactgtcatatatatattttatatatatactgtcatatatatattttatatatatactgtcatatatatattttatatatatactgtcatatatatattttatatatatatactgtcatatatatattttatatatatatactgtcatatatatattttatatatatactgtcatatgtatattttatatatatactgtcatatgtatattttatatatatactgttatatgtatattttatatatatatactgttatatatatatttttatatatatactgttatatatatttttttatatatatactgttatatatatttttatatatatactgttatatatatattttatatatatactgttatatatatattttatatatactgttatatagatactgttatatatatactgatatatatactgttatatatatactgatatatatatactgttatatatatactgttatatatatatactgttacatatacatatatatactgttatatatatactgttatatatattgttatatatatacacatatatatatacatatatatatacatatatatatacatatatatatacatatatatatacacgtatatatatacatatatatatacacatatatatatatacacacacatatatatatatatatatactggctgtgtgtggtggtgcacacctgtaatcccagcactttgggaggccaaggcaggctgatggcttgagctcaggagttcaagaccagctaagcaacatactgagatcccatctctaaaaaaaatacaaaaaggccaggcacagtggctcacacctgtaatcccagcactttgggaggctgaggtgggcagatcacgaggtcagcagttcgagaccagcctggccagcatggtgaaaccccatctctactaaaaatacaaaacattagccggacatggtggcacacacctgtaattccagctactcaggaagctgaggcaggagaatagcttgaacccaggaggcgaaagtttcagtcagccaaaatcacaccactgcactccagcctgggcaacagagcaagactctgtctccaaaaaaaaaaaaaaaaaaaaaaagccgggcattgtggtgcctatacctgtatttgcagctacttgggaggctgaggtgggaggattgcttgagcccgggaggttcagattgcagtgagccaagactgcaccgctgcactccagtctgggtgacagagtgaaaccctgtctcaaaaaagaaaaaatactgtccctgccaaatccaagacagacagcttttctttttcttttcttttcttttttttttttctttgagagagagtctcgctctgtcgcccaggctggagtgcagtggtgtgacctcagctcactgcaacctctacctccctggttcaagtgattctcatgcctcagcctcccgagtagctgggattacagccagttgccaccatgcccaactaatttttgtatttttagtagagacggggtttcaccatgttggccaggctggtctcaaactcctggcctcaagcgatctgcctgcctcggcctcccaaagtgctgggattacaggcgtgagccaccgtgcctgggtcagacagcttttctatagtgaaacaaatcacacaggaatataattatgaccattttccctggcaaatatctaagtaactttaaggtttgtcgggtcctgtgtcataggtgttgccatgtgtgctacctttttcagaaggccccatttaccttgtaaacctctcttcatctctaataggccctgtatgggctctgctgtctcagttttaactgtcttctgcttgatgtgagttcagcctggggatataaagctttgcagagccaatgcctttgcattattccctgaaagcttgactagggaggccaatcattatgggccagggtgggattccttgaactctcttggaatgggctcaccaaggactatctttggttctaggaaaacctatcattttctttcctttaaattaagcgttttcagtggcattggctcagccaagcatccctagcatttctacttctcaaccataggtgagtggtgctcccatgagttgtgcagtacacaacctgcacagccatatgtggcagttgtgcaggggtggcagttctgcctaccctcagtggaagatggatggagatttgttctaaggtaaacctgggatgcattcctcacatatgcaagaaagctgagtgagtgtaaaattagaagtccatagatggagagaggcagagaaacaggacggggagtctcaatggaattccagttcctggtgttgtcttgcaagtctgacttgatctctgccctccccctcatttgattatgtaagctttccaatcaatattactctttatttatttctttttagcataagttaggtttctgtcaccaacacattctggctaaaagcctgagtcttttccttatcttgccccaaatggccagttattgtggaattccactgggttttggctgttggatgaggcactgcgggtattttgcttatccaggttgactttcccatctgtgacactggcctacctaatgagggattccagcaaacaggatggcatgctgagctctcaaaataaacatgtatggcagcctttgcacacagtattcagaaaacaatccattatcagtggcttgccgttattttttggtccctaaatgtattttctggcattaaaaataaaacagcaggtatgctccctccaagaaggagaagtgtgtgtgtaaattgggccttttctactggagggggtgttctggggtacaagtgagggcccagtgagggctcaggctgacaatcaggactacttggaaaatagtgttctcaagagtggaggaagtgggctcaaaggagcttgaggagactatagggggaagcgcaggacaccagccaaggcagtcctggagtgtgcaaggcccaggaccaagatttttggcgtggcccctgtctctttctgttctagtccaggaaccatctcttcatcttttttctgtttgtttatttaatgtaaaatgtgccattcctgcttactcttatattctcatcacaaaaaatggtacattgtttggaacctgttactattgaagatcttgcttttgcagttccctaatacatttatttaatgctggatatatcattatgtacgatgctatatcatctatgggtggctgacttgttctcaaagatagttactgtgccttactgatgagaactacaaatataaatgttgccaagagtatgcaggaaaatgtgcatgataatttattttctggtcatgttaaatttaccactgggaatttttttcttcaatgtaggacaacgcctcttacaactgtatcttgacctcttgaggcccaaatcgctgcattcctataatgtggttgctttcaatgatgactgcacccctgccttccacatgccaccattagcagggagcacagcaagaggcctgtgagcagagtgagaagagcaagctcatttaagcaggatacttccatctcttattctccatggcttaaaaccggtgagagaataatgtctcaactggaggtgtgaaagtacatcaataggaggtgtatgttggtgttggggagcaacatctcaaaaatccttggtggatgttatggactgaatatgtgttccccccacctcccggccccaaattcatatgccgaagccctaacctccaatgtgatggtattaggaggtggagctttgggaggtaattaggtttagataaggtcgtgagggtggaacccccatgataggtttgtttgtttgtttgtttgtttgtttatttatttgagatggagtcttgctacctctatcgcccaggctggagtgtagtggcacaatctccgctcactgcaacctccgcctcccaggttcaagcgattctcctgtctcagcctcccgagtagctgggattacaggcatgcgcccccatgcctggctaatttttgttttgtttttttgttttttgagacagagtctcgctctgtcgcccaggctggagtgcagtagcgcgatctcggctcactgcaagctccgcctcctgggttcacgtcattctcctgccccagcctcccgagtagcttggactacaggcatccaccaccacgcccagctaatttttttgtattttttaatagagatggggtttcactgtgtcagccaggatggtctccatctcctgatctcgtcatccgcccgcctcggcctcccaaagtgctgggattacaagtgtgagccaccgctcccggcctaatttttgtatttttaatagagacagggttttgcctgttggccaggctggtctcggactcctgacctcaaatgatctgcccgcctgggcctcccaaagtactgggattacaggcgtgagccactgtgcccagccgggtttaatgcctttataaaaagcagaagagacaccaaagcttcctctctccaacatgtgaggacatagcaagaaggcaagtggggaagagggccctcaccaggaaccaaataggccagcaccttgatcttggacctcccagcctccagagctgtgggaaataaacatctgttgtttagactgtggtacccaggctgtagtattttgttatagcaacctgagcagactaagacagaggacataggcatggccaatcctggaggacagactgacagctgatccggagtctgccaaagtggtgaggtgactgccctggagtcagctggggaaggggtgcacaggtaaaggatgcctgccacacgtatccccctccccaagatcaccctggctgcaataagccagaggtggtactctggtctgaagacagaggtataagccaaggcatatatccactcaggcagctcaagcacaagcatttgcagagcccagatccttgaactcgtgctgtgtccaagtgagtgaaagcatgtcagcagcatttctgacagcctaatctcatataatctagtgaaagaaattctacaccaggcagcaggagtgagctgcttgcaaggctgctctcagaaccagatctggccatgacgactccataaacatgaattctggagcttctcagggcatctggttgaccctacatatgtgtgagagatgggtaggggtaagagagagggttggagagcaccctgaagaggagaaacagcaaatgggacccacagggaaaggacttggtctggagctcggttgccctacctagatggcaccactcaccctagctagtcccagccactggagagagacttagaaaatttcaaggtagaaaattgtggtcaacaagagtcacatgggatctggtctagacagagacacccttcctaaatggcattgctagccccagaagggcacttacaaacttttgaggaatacagtccaaagtgcaggaccctcttaaggcacagagtctggcacaaggggcctcacttgcctgaatctaatggtgttactaccatcaaccactggatactatccactaagaattaacagtaggagcaagaaggtgggttcagcactgagccaatgaagtttctatccgtcccctcatccatccatccatccatccatccatccatccatccatccatccaacacatgttcattgagcacttaacaccatgccagtattgttttaggttcaggaaaacagcaatgggtctgaccaactatttctaccccaagctggtactgcacaattaaaaaagaaggaaaaataaaacaagaaaaaaatggccacagacgtatctcacatacagctgttcatttacaaacttttctcaattatggttcttgaaaagtgttccaattactgcgactgtatacaatttaacccaaaacttagtggttggggtaaatgacaatgtttattttactcatgaatctgctatatggactgctcaatatttttcatggatccacatctcttatgggctgctctcaatagggttagtttgtccctgctcagcttggtgtcaggttggggtggaggcttgaagcctgggggctggaatcatctgaaggcttcctcactcatatgtctggctattgatgctgactgtcaccagaaacttagctagggctggtagctggaacacctcttcatgttttccttatgtggcttgggcttcctcccaacatggtggctggggtcccagagtgagcattgtgatagggagcaagccaggtagaagctgtgtcttctttatgacctagccccagaaatcacatagcatcacttttgccctattggttagaatggtcacagacgcagccagactcaaggagaaggaacatcaatcccacttctcagtgggaggagtgtcggttacatcataaggagaaccatgggatggatcatatagattggtatggcatctcccagaatgatgctttcagggtaaataaaacaaaaaagactggtgtagtgatctttggaaaaaagtctgtcacaaaagcttataccgctgctcctcttttttccaattctgtgcctttccaaacacactatacacaatgatattttgacattacagttcagatgaagacattccccagtttagtcgatgtttctagttagagatcatgccgtggaacaaatttgaattgtgcactatgtttggagatccaaaatgttttactatgtgtagcatctcatgtgtctcttaagtttattgtacatgtgtgcttttctcaaatgtttcaaagtgttctaatgtttagtctttaattttccctcaaggtatatgtgcgtatgtgtgttttatttttatgtttgtttaagtgaagacttcaaaagttttaaaaaattagcaaagagtgcagaaaaaacatatcttttatgccaggcacagtgatgtgtgcctttagttccagctacttgggaggctgaggcaggtggatcgcttgggcctgggagtttgaagccagcctgggcaacatagcgaggccctgtgtcttaaaaaaacaaaccatcatttagagaaccactcacttgcatctctcctccaccaacttgcacctaatattaaatcttgtctttctgtccagagcagtaagtcttactgccttacatgttatgtaaaaaccatattttaagcaaaattatttgtttgtataattttctgttgcatcaatatattttttctgttaaaaatatttaggtgccttaggctggaattgaacacaattttgcccattttaattaatgggaaaaatttaacagctttccacttagaagcagaatttcaggaatgaattgaaaccactagaagggtgatagctgtattttcatcatctccccaagggctttgggacagctttcccatcctctgtgcctgtcacttttccaattcccatcacccgttgttcttccagttagtcacccctcccttgtctgttacaggggttcagtattaattgtgttagaatgcatctggttgcaagtaacataaaactcaacaaactctggtatatataagatccctcatcccgataagacaggaaggtagtacagggtttgtgtagctgcttgagtatgacttaaacaaacaggctcctgtctttctgctccaccttcctcagcacagccctcctcatggcctctaggctgctgtgctcccaggtgttacccagttccaagcatgaagcaggggaaaagtgaaggacacaaacttctccaagggaagaaggaagggaaggtctcctttgatacttctgcctacatctcagtggccaggactttgtctcactgccacccttagcagcaaagaaagttgagagttgtgtgctttgcttttcagcccctgtagtatagaaaggcaagggagtggttgaaatagatcttgagttagccaactacataatttgtcacactgtgtttaattgaaatgtattgcttggatccagtgtcctggacatagcctcgttcctgtcctagcacattcttaccctccttttccctcttccttcctgtagctatttttctggggggtgaggtgtggtcttgaggaaacactcttcagttttaccctttctgtgaggatactagttcccttatcactcattcctccatagtctcttctaactgaggtgaggagtcagaatcttctttgctcccttctgcttttcagacaaccgtgccttcacctctactcaacaccctgacccctcctccctctctcaatacccaaggtcagtctcaaggccaggtcctccgtgaagaattccaccatccctccctcctcttctttctcagtccaagtttcctcctttagattctcaaagcacttaagctgtacctctccaatggtattattttcttcgttgaagtgaaagcaaattattgaaagtggtactgtttacaaaatgtctagcgcatggcaggtgctcgaagtagtatctcttagtattattactactgtcttatctcgatcagattcagctctttaatgagaggctctaaatcttatgttcgattcacctttgtaacccacaccgggcctggaatagagcactgttcataattaatgctgtgcccgtgtaataagacggcggcgagcaaagggcatcatttcagaggaagagtgctgtaatggtgggatgggagaaattcctagaacctaggtgggagccagaatcttgcagagaagccccttatccgtctgcaccgaaagcaggtagagtggatgccgtaagattcctaaggacgcaggtagagcgcctcctctgtgccgcgatgaggtaggtgcatccgtcacttcactcctccctctccacttgatccggaatgggaggaacgcaatgcgtcccgcgcggcgatctgggatagctgcgcaggcgcagcttccggctctgtgtctcgggaattatttgacgccaccggttcagccccgtagaaagctctgattaggcgcaccgcgcacgcgcagtggcccacttggctggggagttatttgacgccgccgcccctggcagtcggaagttgcctgagcagatcccagccggctggctcgagtggccttcgtcgtcccttggcgccctgggagagtcgctgacgggtggactgacggaccgcctgaggacggccggccagggcggtgaaagcgccagccctatggcgcgggtcgcgtgaggcggaaggccgaggacggccggcggcggcgcccgccccggcgatgcgggccccgcccgtcgcctcaggtaaccgggcagccggccccgccgcggccggaccctcccctctccttccctctcttccccacctggcggtcaagggacggctgaggcttgtttctcggctctgggtgctccaggggcccggcctttggaagctcatctgcaaatttttgggagacccacgggggcggggaaagcttggccctggagtgggcggctgctgtcgagtctgtgtaaacccggtctaatccttgggagctaccccggccaggcgaagctctctcctggcaacctgggggagggggcgggtctggagcggagctagacaactcccgcaaagaatttggtccagcagaaaggttaggcaagttgctgccgcccagtggggacgatgctgcccattgcacagtgacactttgatgagggagagttgatgatgggagtaaacagctaacccccattaagcgcttcttatccgccaggcatcatgccaggccattacgttctccacgtctaacttcacagcaaccctgtgaggtaggattgttgtccccattttactgacgaggcaactgagtccctgggtggttgggtgacttaattacccaaggtcacatagctagtaatttgaaccggagcatccgacccaagtgcttaacaattagggcagtggctctccaactttgctacactgtagaatcacctgggggaaattgtaaaggtttctgatgcccatgtggcatcccagaccaaaacaatcagaatgtctggagttgaaagccagacttcaatattttttttttaaagatgcccaagtgattccagcttgcagcaaagtttgggaaccgcatgtaatttgataattctgcatctcaaaaagcatctctctttctccagcttaagtgtgcaggagaattgtctgggagcttgttaaacttgcaggttccacccgcagagatctttaggttgactgaccactacaccttgtgaaagactgttagggatggaattctctgcagggattctgagtcatctggaacatttaaaatgtatgcatcttatgcaaactgctcgtttgcaattttcctaaatatacagtacttataggtgtagcgtctgtaacctctgggtcgtttttacatatgctggaagtctgcctagaccatcctctgaacgttctggccatcccacccaaacgcacacacttctgctctctcctatatgcatatacacacccttttcttttctttctttcttttttttagacagagtcttgctctgttgcccaggctggaatgcagtggcatgatcttggctcactgcaacttccgcctcctgagctcaagcagtcctcccacctcagcctctcaagtagctgggactaccacgcttggctaatttttgaattttttttgtagagatggggtttctccatgttgcccaggctggtctcaaactcctgggctgaagcagtccacccactatggtctgccatagtggtgggattacagatgcgagccactgtgccaggcctacatacccttttcttcctgtctctggctgcattagctttaagcattcccttcaagatacctctgtccctgacccctacccaccttgagtccttccaatttgctctttaggaacatcgtagtgaaacttatcagttatttttctgagttgtagttctatccctacttctagattatgagaagctttagggcagggactatgttttcttcatctctgtattccttccagtgctttgacatacagactcacaaagcttttactcagtggaatgtttgggtccttttatgtcatagatagatcatgttgcgaacagattcttctctatttccatttttgtaaaagatgtttggtagttcccagcttatagagttttgttctttttgcttaggagtgagtattctagttatgttcagcaatttgtccagcagttgaacacacacattgagttcttaccaattgcaaggcactctgtaactaaccatgtgcaatcaacattgtttgatttttaatgtctgattctatcacaatcggacgcaatcatgtctgtagggaaagtctttttattactgttagacctttgcatgtgttccctacttcattgtccaaaaaagtgtttagttgtcatccactaaatgccactgccttgttggtatttggtaaatacaagcagatgggattgccattggtaatgtttggtcctgttcaccaggagagaggacgttaagtacttaatgaagagtaaaatcatgttgtcacaggaattgacaaatttagcacatatttattgcagaatgcctgaactgccattgccccatttgccatatttacaagtttaaaggaaggcagaccaataattcagattggatttgttcttggttggtcttaaaaccatgtaaggatttgcaaaagttagtgaatatgtgtgtgaaggtcattatgaggaggtttttggacaataaagatttttttttgtatagcaattaaacatgacaaagtatgtagactgaattaaaaacacatttcataaaattttttttttcttttttttttttttgagatgcagtctcgctctgtcccccaggctggagtgtagtggcgcaatctcagctcactacaacctccgcctcctgggttcaaacgattctcctgcctcagcctcctgagtagctgggactacaggcacccaccaccacacctggctaatttttttgtatttttagttgagagggggtttcgccatgttggccaggttcatgtcgaactgctgaccttaagtgatctgcctgcctagtcctcccaaagtgctgggattacaggcattagccaccgtccccagcccataaaatattctttataaggattgttatagaaaaattttcttggttccgttttgtattatttggtcagtttttaggcttagcactaatagaaactgatgggacaacttatgttaaattcagatactcaagaaacttgtccttgtgtgtctgatcagatagggacacagtatccagttcttgctttagcacatggaagaaactcaatctttaaggctgaaggtttaagtctgtagttgtgccccaaagtaaaggtgaaaaattccacatgctcagagaacaaaagtgactctaatcatgatagcttgggacctagaaatggattctgtttaatacgaggtactcatcagtgttagcaggtgtgtttcctgacatgtgcaaagactttttgggcagaatagttgattttctttggtgcgagatgatttaagttttaaaattaaggtgcatggagtttcattctaactttttatagatgcggaaagtaacttggtcaaggctacatggttagcttctagcacctccaggactagaaagcaggcctccttcctctggacggtgtcccctttcgcccccgaccccttccccatgagaaaggttgtcttgtgtattgttgtgttgtgtttgcctgtctgtgtgtgcatgggatagggaaggggagagagtgatctgctatgtttgagaaactcaattagatatctagaggcccctcgacttatgatgggattacttcccaataaacctatcaaagttgagaagatcgtaagccaaaaatgcatttaatatacctactgaacagaatagcttagcctcatctaccttaaacatgctcagaacatttacattagcgtacagttgagcaaaattgtctagcacaaagcctattttataataaagtgttgaatatttcatgtaattgattgaatattgtactgaaagtgaaaaacaatggttatgtggataatcagagtacggtttttactgaacgcatatcactttcacaccctggtacagttgaaaataataagttgaggatagtgagtacttggtgtgtgaaatgcacttagctatataaactgggaatacaaagataaataagacacggcccctgtcctcaaggagtctaatcaaagttataataaaataatagtgtagtatctgaagcagctctgtcaaatagaattttctgcaatcatggaactaaatcttacttgctctaatatggtagccactggccacatgtgacttgtaagcatttaaaatgactagtgtaaccaaggaagtgatgtttgactcaaatagtttaaacttaaaactattaaaattaaaagtttttaaaatttaaatagttacatgaaatagctgctgtattggacagaggtctgttttatgcctcagagaaggtctcaggcataaaagatgagaactgtggtggtgctggtagggggcagacagggtattcaaacgttctttgggtagcttaccaaaaactaccattttccatgttttgggagagatgcaggcagaacctgtctttgtttcctgtaattcaggtgtttgataggatctctaatagcatctggtacataggtgaataccttccttttttgccagctttattgatgtttgccttatggggtcaatgggactgcaacagcaatatgaatcatgaggttatatggatgaatttggtgcaccttaaaaaaagcacagtttatttatttgctcagtgttttagcaccctgtatcctatttttcccaagagaaataggcatgtcttataatgtgtaccttccattggtacatttcaaagtatgtcaacttaggttgctttatttgatccttctcccaggtcactctagataggcactgcaggtattctccctgttttacagatgaggaaactatgacaaagaaatgccaggtcaccgagtgcggtggctgacttgtaaacctaacactttgggaggccgaggtgggaggattgcttgagcccaggagtttgaggccagcctgggcagcataatgagactttgtctctataaaaatttttctaaaaattagcggcgcatggtgacacacacctgtggtctgttacttgggaggctgagtgggaggattacttaagcctgggaggcagaggctgctgtgagccgagatcgtgccactgcactgtagcctgggcgacagagtgagaccttgtctcaaaaagagaaatgccagttgacttatccaaagtcatatggtgaggtatggagtcaggacaaagggaagtagcattgcactttgaggcaagaggtggagtttcttgtcccagatccgctgttacttgatgtgatcctgagcaagtcatagctttactttgtttccttacctagtggttagtgacgtctgtcttacctaaccttctagggttgttattggaataaaatgaagtaacatgtaaaagctctttgaaaatgataaattatgcaaaggtacaatgtgctcaagcaagacctcaagtagtttttctttttttttgagacggagtctcgctctgtcacccaggctagagtgcagtggcgtgatctcagctcactgcaaccttcgcctcccaggttcaagctattctcctgcctctgcctcctgagtagctgggattacaggcagccgccaccacacccggctaatttttttatttttattattatttattttattttattttttatttttgagacagagtttcgctcttgttgttcaggctggagtgcagtgacgccacctcggctcaccgcagcctccacctcctgggttcaagtgattctcctccctcagcctcctgagtagctgggattacagacatgcgccaccacgcccagctaattttgtatttttagtagagacggggtttctacatgttggtcaggctggtctcgaactcccgacctcaggtgatctgcctacctcggcctcccaaagtcctgggattacaggcatgagccactgcacccggccaatttttgtatttttagtagagatgaggctttgccatattggccaggttggtctcaaactcctgacctcaagtgatccacccgcctcggcctcccaaagtgctggggttacaggtgtgagccaccacatccagcctcaagtagtttgttttgttgtattatgctgctgtcgtaactcatcagttaccatattgaatactactgtaccatggtgtcatctttgatttctcttgtcttcctcactatgaaactttctcttgggcagccattgtgttttgtttatattaggatttgtcctaaatcctaggacaaatttgacatgtagctggtgtttaatgtttgtttaatgaaataactgatgtctggatgtactttacaaagttttaaagaattgttttttgtaatgagacttgaagctccttgggaacagggatgttgtttattttctgtgcttgttgcatagaaggcatgtaataaatattgtttgaatcaattgatgtaattaatgtcaggctatggtcttagagtgtccaccattgtattgattattttggtaatttgtcatttagaccaaacttgcatgttattttgcggtggtgcttacaagccataagctgttacccagcacacacaacctccagagagaatacctagaaaatgagtacatatagagttgggaaggaaattaagggatctgcaggggagcactgttgacttcttccccttcttcccattatatttacttctggagcattgaaggtagaggtttctctgctagcagctcaggttgatagcagacagccacctggggaggggactcaggatccctaatatagcagttgaagtccttaatcatctaacttgacagttatatcattatatctcactacagtgcctgaaacctccctgttacccccctgaccgccctcaaccttagcctatatggtagccacattggagtttgctcttctactatcccttcagtgtatcttggacacttccatcaaattgctttaatggaaatttagttcccgatgtgtcatgcctgtggtaaggttaaactttcttcttttttttttttgtttgagacagggtcttcttctgttgctcaggctggagtgcagtggtgcgattttggctcactgcatcctccacctcctgggttcaaacgattatcatgcctcaggttcccgaatagctgggattacaggtgtgtgccaccatgcccggctaagataaggttaaacttttgctcattttctgcctccagttttactgaattaattacaaatattcaatcctaacattcagagtccttcaaaattggtcactgcttacctttgaaaccttaccaccttctacatatagctttctttcctttggctctgggttttcggtttctagtgctttttttttttttgctacctgaagcaagtttcctttcttttatgtattttcttttctttctttctttttttttttttttttttgagatggagtctcgctctgtcacccaggctgtagtgcagtggcgtgatcttggctcattgcaacctccgcctcctgggttcaagcgattcctctgcttcagcctcctgagtagctgggattacaggcgcacgccaccatgccctgctagtttttgtatttttagtagagatggggtttcaccatgttggtcagcctggtcttgaactcctgacctcaggtgatttcacctgcgtcggcctcccaaagtgctgggattacaggcatgagccaccacacttggctcttctatgtattttgttctctcttttatctgtgactcccccacccccgccccccccttttttttttttgagacggagtctcgctctgtcacccaggctggagtgcagtggcgcaatcttggctcactgcaagctccgcctcccaggttcacaccgttctcctgcctcagcctcctgagtagctgggactacaggcgtgtgccaccacgcccggctaatttttttttgtatttttagtagagacggggtttcaccgtgttaggatggtcttgatctcctgacctcgtgatctgcccatcttggcctcccaaagtgctgggattacaggcgtgacccactgtacccggcctcatctgcccctttttaccctcagtcttatcacctcaattttcttacctccatcaaaattatacccttccttcaatgcacaattcgtatgctctgtatctgtagtctttcctgatcttaccctgttgttttccagctcagcctatctttcaatcaaaagtaatctttttcctttgaacttccgtggtgtcttgcctatagtttttaaaaatatcacattcaacattttaatgttctaacttatgttatagttatttatggtaggtattagtctgttttcatgctgctgataaagacatacccaagactgagcagtttacaaaagaaagaggtttaatggagaaatcctagttccacgtggctggggaagcctcacaatcatggcagaaggcaaggaagagcaagacacatcttatgtggatgacggcaggccaagagagaacttgtgcaggcaaactccggtttttaaaaagccatcagatctcgtgagattcattcgctgtcatgagaacagcgcagtgaagacttgcccccataattcagtcacctcccacagggttcctcccatgacatatgggaattgtgggagttacaattcaagatgagatttgagtggggacacagagccaaaccatatcaatgtatacatcttaatctccttaattaagccataaactcattgaaaacaggaaccaagtcctattaatctttcttcttcatggttttaacactgcattggacaaaatagatggttaatagctgtttattgaataagtctacttggtggtccccgccagtgtctctgaatgttcatatgtatagtcaggatgctgacatatacttaccaattctatgacataaagatgtagtaataaaaacatattacattaagttgtaccaacatttctaccactaagttaaaactacagttgactctcgtacatcataagggttaggagcactgaccctgtgcaatcaaaaattttcaagtaacttttgactctgccaaaactagtaatagtcttctgttgaccaggagcctggccaataacataaacagtcaaataatacatattttgtatatatattatatgctatattcttaaagtaagagaaaagaaaatgttattaagaattagaaggaagagaaaatgtatttactattcattaagtggtagtggatcataaaggtcttcatcctcatcatctgcatgttgagtaggctgaggagtaaggggaggcattagttttgctgtctcagggatggcagaaatggaagaaaatccatatgtaagtggaccttagcagttgaaacccatgttgttcaagggtcaactgtacttgcatttctctaccatccttctaatctttagtcacagctgtatgtttatctttttttttttttttttttgagacagagtcttgctgtgttgcccaggctggagtgcagtggcgccatctcggctcactgaaacctcaccctcccaggttcaagagattctactgcctcagcctcccaagtagctgggattacaggcacacaccactaagcccagctaatttttgtattttttagtaaagacagggtttcaccatgttggtcaggccggtctcgaactcctgacctcaggtgatccacccaccttggcttcccaaagtcctgggattacaggcgtgagccaccgcgtctggtgtatgtgtttatctggttgtaattatgatatatatgtttttctttctctaatagttatttattgattgcttacatggacaagggcatgtttcaaacggattacatatgtgattctttaatcaccaccacaagaaacacaatgtgtaggctcctaatctactatttgcttttttttagacagagtcccgctctgtagcccaggctggagtgagtgaagtggcacaatcatggctcactgtagccccaacaccaggatccaagtgatcctcccacttcagccttcagagtagctgggactacaggtgtgtgccaccacgcctggctaacttttttgtgttttttgtagagttgggttttctccatgttgcctaggctagtctcaaagtcttggactcaagcaatgtgcccgcctccgcctcccatggtgctgggattataggcgtgagccaccatacctggccttattctattattatccccattttacagatgaggatgttccaacacaaaagtagagtaacttttgcaacgttacccagcttgcaggtagagctgggatttgaatctatgaagcctagttccagagcactggctcttaaccactctcatctatgtttttatgcttctctgtaatctcagtgtttaatggctacataatagtatatagaattaatatgtcctaattatgaaattttcccattattgatggaagttaaattacacccacttccccatcttatatgtaatactacagtgagcatcttgtacatttttaaaaattgagctgttttataaggataaacaagtcaaattaccgggtcaaggcaccctttgtcttctgctttgtactggcaaaacgttcatgctatccttgggtgaatgtttaggaaatgacatatcagcctgaggtgccttacaagtgtgccaacttactaacgggatggagctacaaacaaccccatggcaagtagactaagacatggcaagtgtgatcaagacatgtgagggttctgccatggtgctatcctgagaggttgattcttgcctaggagggcctaggtggtgcagcagtactggctcctgaaagtaacgttctccaggatctccaaggtttgttgctttggatagcctaagccgcaacagcaagaggaggttcttatttgtgtgtttaagagtaggctgggcaggcgcagtggctcatgcctgtaatcccagcactttgggaggccgaggtgggtggatcacaaggtcaggagttcgagaccagcctggccaatatggtgaatactaaaaatacaaaaattagccaggtgtggtggtgggcgcctgtagtcccagctactcaggagtctgaggcaggagaattgcttgaacccaggaggcgaggtcacagtgagccaagatggcgctattgcactccagcctgggtgacagagtgagactccatctcaaaaaaaagaaaagaaaagagtagactggccactgacaatactgggcctaatggaactccctctaccaaatctgtcactgcactttgccttcatcccttttttccctaacagcaaccacgatgaaataaagtgaagttgtaggacctccatagttgggttataagcccagccccagcaacaaaggtgggttggggtgacttctggggcaccaacagcttatacaaagtatacacttcactatcctctttccacaaggattttgctataattcagttaccaaaactagtatatgcctttatctgtgatcagaggcataaattggaccatagataagttcttttttagctgacattgtgtttttttgtttttgtttttgttttattttgttttgagtttagttgataacatttaaagagtaggagactgtagaaatgtccagattttctgtgtctcttcaaaaattggattatctggcaagtctaggtctgcattccttctaggtgacagctagaactgtgtaatagctgtaaacagagcttgtatactagctcttgttgcccaggctggagtgcaatggcgcgatctcggctcacagcaacctctgtcttccaggttcaggtgatcctcctgcctcagcctcctgagtagctgggattacaggcatgcaccaccatgcctggctaattttgtatttttagtagagttggggtttttccatgttggtcaggctagtctccaactcccaacctcaggtgatccacccgccttggactcccaaagtgctgggattacaggtgtgagccaccaccacacctgcctggtgatgtgatttttctagagttgtgaacagttcttggttctaaagataatgaagcttagtcttcctcaatttatatgattaattgcattattggaaaattcagtctattaaaatagcacaatatattttgtatttatatgtaaatgaagttaatttttaggctcagacaatggttttctagcagatgttcaaaagtcatgtgagatgtggcataattgttcattgtgcaggactgtctcatgcagtacaggatgtctagatttcctgactctgcctgtaataccagcagcttgccctactcattgtgctaaccaaaagtacacttatttccacagtgcctctaggtgacaggtttttctattaaaaatcattgccctaatctctcagttgggtccttacctcctcatcagagttgagttttttgtttttttgttttttctttttttgagatggagtcttgctcttgtcacccaggctggagtgcagtggtgcgatctcagcttactgcaacctctgccgcctgggttcaagcctctcctgcctcagcctcctgagtagttgggaattacaggtgcccgccaccacacccggctaatttttgtacttttagtagagacggggttttgccctgttggccatgctggtctcaaactcctgacctcaggtgatctgcccgcctcggcctcccaaagtactgggattacaggtgtgagccagagttgagttttatcgcttgttttgttagtttaataggtacaaaatgatactttagttgcctttgtgttttttccatgtttgtttctaatgtttatgttctcttcattgttttacttaatatatccgtaattataatgcatttctttgttttaatgttttttgtctgcattttgttaaagtttagcatcttttttctgttacatatattttgatgttttagttcagctttttcattgtatcctttctatatcttttttttttttttttttttgagatggagttttgcttttgtcgcccaggctggggtgcaatggcaccatctctgctcactgcagcctccacctcccggtttcacgtgattttcctgcctcagcctcccaggtagctggagttacaggtgtgtgacaccatgcccagctaatttttgtatttttagtagagacagggtttcaccatgatgttgtccaggctggtctcgaactcctgacctcaggtgatccacccacctcagtctcccaaagtgctgggattacaggtatgagtcaccacgcctggcctatatctttctattttacatgtttcttgaaagcattttttggtttcatttaatcatttaaacattaatacatttagagaatgaaaatttcttacatttaaaaacttaaaaaaagtttgtcagaaggatttaatagctattaaacctattttgattggtctttcataaggtatactcctctcttcagaattgggagggtagtggccatttcttaaaaatgcagattctcaggccccagctcagacctgcagaattgagctttttctgaatggggtctaggagtctgcattttcagctagaccctttcctcccctgatgattcttaagtgtacagtagagtttgagagctagtttgtccttttttttcttcttaaaatctgttttcttccaataatatgctgtgatggatcctgaatattaaatattcatttagtatttggaaaccatccaacttttatttttactagtaattagcttcaaacaagtgaacatttttaaatttttatttgaatataacatacaaaattttggacacactttagtggaatagagggaataccttctgatatcttcctttttcccactggtaaaccttgacactctcaaacacatggtcaatgtccactgtgtgctagggactcagaggttcaggaggcaaggtccccacccaaaaaaggctgacacttttgtggtgaatgtatccgtacaccactaatgaatgagctaatggcagctttatatgaacatccggtaataggcactcagctgagaggagttggtctaaggagtcaagaaaggttttaccaaagagaggacatttgagttgggctttgaaggctgagtacttcataagatggatcaaggcagggaatggcagttcagtcagtgggagcagcatgaccagtgacttagggtaagaaaggatttgctgggcttgagcaatcatcagtagttctttgtggccattgcttgggatgtttgtgggaaagtggcagtagaagatgaggctggcaaggtagtgtatgcaattcccattagaattgtagcaaggctttattgttgatttttttttatttggataaaataataaatcgtatactgaagaataaatgtctagagaagacaataaagttttggaaaaaacattctataaagccactgaacttaaatcattatgggttggcatgggaatagacaagtagttgagtagaacagaagtttcatagattctagaagaaatgaaaatttaatatatgacagaattagtatttcagtttagtgcgaaaaggatgtatttttaagaggtgatgctgacacaactgaccatacatttagaagaaagtaaaatcagacctttcctacaccacttacagaagtaaattccagatgaatatacaagttaagtgaaaaattatgcaattatcttgcaggaaaatctaggagactacatattcacattagggttatgttttcaaatttttggactaagacctatcataacaaatgtattttccgctgggcacggtggctcacacctgtaatcccagcactttgggaggctgaggcgggtggatcacctgaggtcgggagttcgagaccagcctgaccaatgtagagaaaccctgcctctactaaaaatacaaaattagtcgggcatggtggtgcatgcctgtaatcccagctactcaggacgctgaggcaggagaattgcttgaatcgcggaggttgctgtgagccaagatcacaccattgtactccagcctgggcaacaagagcaaaacttcgtctcaaaaaagaaaaaaaatgtattttccattgtgacccagaacatatgcatatattacaaaggaaacaagtttcacagaaacattgcttgcctttattatgtgtgatgcctttatcatacatcctataccatctaattaaaacaagtattatccataacatttatttcatgacccatagtttgaaaaacattgatagtttcatgacccacagtttgaaaaacattgatagaggcaagatgtttgcagcattctttatcatgccaatagtctatacatctgttttatttatttctgttaatttccaatagtataatttgacatgcatttctgttttgtcttttcaggtgccatttggattgtactttagtggcacgatgtactctgagtggaggtcactgcatttggtgattcagaatgatcaaggccataccagtgtgctgcacagctatccagagagcgttggacgagaggtggcaaatgctgtagtccgtcctcttgggcaggtgttaggtaccccttcagtggctggtagtgagaatttgttaaaaactgacaaagaagtaagtgtttctaaatttcattctcttatatgaaaatgtacatttgttcttgaagaatttgtttaatgttaacttttttgttcttttttctttgaaaagagctgtagtagaataacgtcaactttttaatggatttctccccaacgtagtatgacttctcaattttgatcttgtttgagttgagggctgggactcggagtttgtggaggttataaggagtgagttgtactgttttgctgctgggactttttactagttatggtcaattctccacttgagctgaaggccaagacaaagacttgaatgtcaaacacttcccccaaagatctaggcttagtcttctgatttccatttagagtgtgtttggaaggcctcatccctacctctggatggcccctgactgaagactcatgtcaagttttcaggctatgtgtatgctgtgcttaagctctcccctgtccccatccctacctactccttcctggcttccaggtttaagagtgctgcagagaagccaagcccttctggcctaagcctaggtgattggaattggggttgtgtttgctgtttctttttttttgacagagttttgctttgtcactcatgctggtgtgcagtggcaccacggctcactgcagcctcagtctctctgggctcaaatgattcttccaccccagtgagtccccagtagctggaactacagacacatgccaccacgccaggctaatttaaaaaatttttttatagagatgatgttcttactatgttgcccaggttgggtgtttactgtttctaaagataggggctcttggaatggcttgccctgaagctggccctttgttcttgggttcagcggcccaggctgaagttaaaaagttgccattgggaagtcatgaaggggccctgagaatggagtgatagaggagcttgctagtataaattctggctaagatgcaggattaaaactttgtcccttgtgttgaagaagctcatgcaaccttcagacttcatgtttagcaaaacctgtaccctatttctcagaccctttttttctgtttgctttttggtttcctgtgaaggagagattagacttagatataagactaaaacttgtagctctaagggtaggatcctccttcagccatgggtctctgaagagtaaaggtcttcagtctgaggaacatttttctctcttcagaggaccctagatttatccccgaggactagcacaggccctagtgtttctcttcctggtgcgtttgtgatcccttgttgccttctcctgggaagagatggtacgtgagtagatagaggtgctctgatgcagcccttttttttctcctttctcaccattgaaaagagatgagaattcctgtttcctctggaattatacttttttttttttttttgagacggagtctcgctctgtcgcccaggctggagtgcagtggcatgacctcggctcactgcaacttctgcctcccgggttcaagcgattcttctgcctcagcctcctgagtagctgggactacaggcacatgccaccatacctggctaatttttgtattttaaaaatgtatttttatttatttattaattattatttttgagacggagtctcgctctgttgcccaggctggagtgcagtggcatgatcttggctcactgcaagctccacttcccgggttcacaccattctcctgcctcagcctctcgagtagctgggactacaggcacccaccaccatgcctggctaattttttgtatttttagtagggacagagtttcaccgtgttagccaggatggtctcaatctcctgacctcgtgatctgcccgcctcggcctcccaaagtgctggtattacaggcgtgagccaccgcgcccggcctatttatttattttttgagacagagtctcgctcttgttggccaggctggagtgcaatgtcgcaatcttagctcaccgcaacctctgcctcccaggttcaagcgattctactgcctcagccacccgagtagctgggattacaggcatgcaccaccatgcctggctaattttgtattttttttagtagagacaagggtttctctgtgttggccaggctggtctcgaactcctgacctcaggtgatccacccaccttggcctcccaaagtgctgggattacaggtgtgagccactgcacccggccaatttttgtatttttggcagagatggggttttgccatgttggccaggctggtctcgaactcctgatctcagatgatccacagtccttggcctcccaaagtgctgggattacggttgtgggccactacgcctggcctagaattataaaattaaacaactgtgtgaagatgccaccaaagatatcttcttggtttttcatctgataattagggacctgcaatgtcttttagaatctcttctcttatgtggctaaatcttgctacaccctgctccaaatttgtcacagcttcactgtgctgttataggcttctttaacacttactgcagttaaaccatgtatttcctacccttaacctttgtagttgcttttgagcttaacaaatttaatacatatatttatcttgttagatttaactttggttttaagctgttgaagcctttttgaatcctgaatttctgtccaacaagttggccatcctttttagctttgtggtatctacagatgatcagcatacactgtttttctttttttttttcccctaagttagaatcttggcagagcctttggcatgccactgagcacctttttccaaaatgatcttggcatgttaatctactgttactctgtcatgtgatgtcttgaccagttgtaaatctagccattctaccatcctctgggccatatgtctccatcttgtccacaaggagatcctgggtctgtctagatttcttgctaacacccagatacccgtttgccggagaactctgttaatggtatggagagaatagcttaaaatttctagttggaagaccagggttcaagttttcagctccaccttttataaaccagtgacttatgccaaattgcttaatcttgctaagcttctgttttcttatgtgtacagtaaggatagtttaccctgtctacacagagttattgtgatggctagatgatatttatgaaagtgctttgtaaactgcaaggactacactgttgtcagccctctaaatagtaaccctattaataaaggaatgaagctcatttggcatggcttgatcttattgagcaggctgggtcttggtgatcatgcttctcttttgtgagtgttcactgattgcttagtaatttgtctcaaagttttgtctggaattcacttaaactttccagtttacaatgtctggaatacagtttcctcccttttttgcaaattggggtttctcatagatggagacatatagctcagatgatggtagaatggctggatttataattggtcaagataccacatgacagaatagtattagactaatgtgccaaagtcattttggaaaaagttgcccagtggcaccttctagttggaagaccagaattcaagttttcagctccactttttataaaccagtgacttgggccagattatttaatctctacaattacgactgccggcagcctagtggttcagccgtctcttaggcaagttctctcagtccttaggatgtgattcagctaggtcaggaggctgggactcattcagtgcagctaaatgccttgttaagatcttacccagcttcaatcctttttcagatgtgtttgttcttcattttaagtattattattatttttttttttggcagagaacagttgtaaagtaagagtaaacagttgatctttcttcctgttgtttgtgcatttgcataatctggagatggaatgtgactgactttatatgattttctaaatgctacacatacttaaacattaagtggagaaaaaactctaaaatgttctattttgcatatctaatctctatggaaatttgaaatgacctgtatttactttttagttcacagagcaaataataataatatctaaagggtaaaaaccagcataggcttgatattcaaaaataagtaatttattttcttcttaaagcttttgcttgggaaattgtatgtttgatatgtgaaaaatgcattatctaaaataaatctgatatttacgttgagacgaatatactgtcaatttagaggtttttggcaataaaagagattgacattttaaatcagtctactgagataggaacgtgtaataattctatatggatattttcttttgtctaggtaaaatggaccatggaagtaatttgctatggactgacccttccattggatggagagactgtaaaatattgcgttgatgtatatacagactggattatggctttagtgttgccaaaagattctattccattgccagttattaaagagcctaatcaatatgttcaaactatactaaaacacctacagaatctttttgtaccaaggtaagctatacctgtctatctggcccattatcagggtcatagtaaaatattcataaacgttactatagtataggagctgatttcattgttagtcctctgaacagtgacttcatgtgttcagttaaagattgtattaatgtgaatgttaggagagatgggcttatgtaatgtttactaggagtttttaacaggtatgtgttctttaaaggtttttagctttgcttctaaaatctcatacctgttagatattaaaatactgtaacatctttcccttctactcaaaaaaatatacttttgcctatcacaattcttgtttccatttaggctaaacacaactaagggagatgcatctaccttaataggcatctttcctatgagagagtgaagacacttgaaatgattatgggcaaattgttagtaagccaaaagattcctcttgatagtttgtttctgatttttttttccatcttaggcaagggccttaaatatcataatatagggataccttcaaggagcagtagaacatgtttccttttggtaaagttctggttagagcttttggtctgtcatacggtgagggactttgaaaaccagctctgtaagtttttaactttctaaatatagaagggagattactttggaaaatctgaattaaaaaagagaagtctccagaactctggtctgtaggctcaggtgtaaacagcataccatgcatgaaatgcctggtgtagtctggcccctaactagactagctgttctgaattctgcgtgagtgctgctctgtagtcagactcgtaagtcagacattcctctaagacctcctaaagatctttcccatcatgatgtctttttgtcttcttcctcttccttctctccatcaccacatctcattcttgttggttctttaattctgccttgtgaggagaagtcctacctaaccactcaggcccacagcgatcacaccttctctgaacctatatgatactttctgcatcactcttgtatctctcactgttttattgcttatcttttaaaatgtgtgtctcctttccccatctaaccaactcaaaggcaggaactctgttgtctctattttaggcttccacagtatctggtgcaatactggtattttaatacttagtacttatcttaggtgtcaattaaatgcgtgttgtttgtatttattgatttcacatggaattaaaaacaggaaatgggccgggtgcagtggctcacgcctgtaatcccagcatgtttggaggctgaggcgggtggatcacctgaggtcaggagttccagaccagcctggccaacatggcgaaaccctgtctctactaaaaatacaaaacttagccgggtgtggcggcatgtgcttataatcccagctacatgggaggccgaggcaggagaatcgcttgaatctgggaggcggaggttgcagtgagccgagattgcaccactgcactcagcctgggtgacagagcgagactctgtctcaaacaaaacaaaacaaaacaaaaaaaacaggaaacggttgggagtacttagaatattgtttataagcaggttcttctaaaatggtgtaatagttttaatactttcttgttatcttatttaggagcctactaggctttttcttcgtgcctgggatagtctcatgagtagtattgtcactgtgtctctttcctctttgtaagcctactacctttcagtgctcagttaatttgtattgatgaaaaaaaattaatggcatttgagttaattaggcttgtgcctttacttttctcttttgagaaacatgactaccttataaatggttttgctatttggtaattaccttgttttctcaaaagtatgtgtgcataagtgttagtaaattctgagagggtactcaactgagaattagagttctcttcctggctaatgttttaggaaaattagctgaatattttcaatggtaagtattggtgttatgatctcatctcccattatttgaagttttagttgtttatttgattctgatagttcacaaaactgtcatctaagtttacttaattagttgtttttataaaaactgacattcaaaatggagggaactgcctttgccattttgctagagattatgtcagaatgaatgtaacatttctcttttgcccatcagtttgatttttttttttaagattgagtgaagagtaaatcatcttttaaagttggttaaggttttaattgctcacatatactatactgtactttagaaaaacatattattgttctgaagcagggttagcaaagagtcagatagcattttaggctttgcaggtcatatagtgttataattagtcagttctgctggtgtggcatgaaagcagccatagacaatatataaatgaatgatcattactgtgttccaatacaacttcatttacaatatagatagtaggccagatttgtaaactctatttacaataaaagatggcaggccaggtttgacccattggccagcattcaccaccactgttctaaagcagtttttctgaaaatcacaagttacattttaaaaagtaacttgatatttttgaaagggaaatctctggtgtttagctcttctgtttttttttaatgtaaaggttaccttgtttcttttagctttagaactttggaccctgcctctgaatttaggccttctgaatgaggaggaaggagcctcagtacctgaggaacaggtatttcctttcctgtcattgggcaaatacctggaaatggtaggtagacctaagttaccatgtaggaggcatgcactcttggaagggtgtcagtcccagggccattagtggtatttttatttcttattctgggcttcctcttatattacttgattaggtttggggctatgctatagttttttattcttcttcaagtaagccagagcaatagacacaagcttgagccttagggctttacatggactagatccacctttactagatccacctttagctgaatgtggaacatctccccgctcctggaggtgcttggctcttcctaggcaattttctcatcattttgctttaggtctgacttctttagggaaaacttagtggtgtcatttgcttgcaactctagggtaagtgtcgttttctgcatcatagcccagaatctgagaatctctcttctaaggttgggttgacagttctaagggaactcacttcattttctggaatttcttgaggaaactccccagtctgattcaggtatgtttctatcagttctttgtgacaaatgacaatatgtagaaacttggcctcaagacttttttcagtaatattagatacttctcttgggtttcccataagagatctggaggccagcttaccacttgctaatacaatgggtttcctactattctcaaaattctcagtggtctactttggaaagtgagggtaagggctgggacctggacctctatcttcatcttcagtcctagccaaaatactttgatctgttttatagatcattcttctttataagatttcccttggaaaaaatggtcctgcggtgagttttaaaactgttgttccggggtatcctgggaaacttggagcctccatctttggctaagtgtctttttctaaaattagagcagcagtagcaggtatttatttctgaagcaatgcctgcatacctcattaattttggggacctattaggctattccttctggcttgtaggcccttctctaacagaccttagcttcagagggactatgagcactgtaaaatcacatgcagaattcttgcaaatatgtgtttaaaaaaattaaaaaagaataccaaggccattctgcttcaatgtgagcagcaagggtggcggtgggtatttacttgttcattcaacaaaaacctattgagtgtctgctattatgtgttaggcacatgttagacatagaaaatccagaagtgaagtttatgttctagtattcccgccttcctcccagaagctttcgagttctcataggagtggtaggtttagattccagagtgcttaactttacgacgagtaagaagtagctttaaactgaagacggtatgcctagccctctctgctgataatattagggagcttcattggaccactgcttgctacatccataagtcacctgtcctgaagctgttgctgtctctcctccaggcttgtcagtgatatctgtctgtcttcttcagacaggaacagggttccagtcagattcgactatgcttacaggtcctgagagccattcagaaactggcccgtgagtcatctctcatggcccgagaaacttgggaagtcttactgttgtttcttctgcagattaacgacatacttctggccccaccaactgttcaaggtttgtttatttttttttttctaatttatttctgagctccaaatacagttcatctttaaactcagtgagcggtagactcattggggatttaaattttggcatgatggtttacaaacaaaggttaacagttcttagaatggaaactctcaggcacaatataactttagccctgatgaagttattttaccttcagtcatgattttgctaatgtagggagggactcagtgaattatgcatgtttgatagtgatgggagcagtagcttgtttaataggataggccaggcgtagtggctataattccagcactttgggaggccaaggcaggtgtatcacctgaggtcaggagttcaagaccagcctggccaacatggcgaaaccccatctcttctaaaagtagaaaaattagccaggcgtggtggcacacacctataattccagctactcaggaggctgaggcaggagaattgcttgaacctgggaggtggaggttgtagtgagccaagatcgtgccactgctctccagcctgggcgacaagagcaagactctgtctcaaaaaaaaaaaaaaaagaaaagaaacaattaaccaattaaattagagcctatagataatatattacaaagtagttatcaaagtagagtctgaaaacttggtagtgacaagatattttactcagcaaatgaaacctccaaagtcttttaactgttctatttggaagtgtgccagtttgctattcattagctagccattaaatgcctccagttttataagactttacagtgtatttcagaatccctgctttgtatatagcacagtgtatataaactataagttgatcatctagttccaagttctcttgttgcttattcattggtgtactctgttgactaacacatgtgagtgtgcttgtgttctcacacagatgcagtattcagggaaatatctaaaaggaagcatggaatttcagtgtgggaagggatgcaatgatagtaatactctgtctggtattgacaatagctggacagtcattgattcatcacctctctgctacttactccccatgccaggggtctcaacagcatgaggcagacaattcatccccctcctgggctctttgttgttgaaactttggttttgctcatttgaaacacacattcttacaacttttcctgtgagtcccaactttgccttctggagctatgcggtgtaaagaccactgctgtttttccacctggttccagggcttagaacaggggaacagccccattttcatggttaaggctctgtccttcccaacaccagtccttttgctccattatttgtctctctgtctctctcccttgaagggtggctttcaaatacttggagcattgtatggcaaagtttggaggtaaaaagacatgggtgtttgttgtgattccttcacttactggctgcatgaagtcggagaagttacttaaactttctgaatctaagttttctcatcttcaaaatgggtataattagcagttggtattaggtattacagatacctaccctgcagaattaatgtgaggattatatgaggtcatttgtatgaactatttggcatagaaactgactcatagtagtcagtcatcataggcagtcatccttttccttctcccctgtgtccctctgtcccccttgctggaggattaaggccttcaataagaactgaacagggcaacttgaaatctttcaaagtaaaaattttttgatgtgtctgtgattttgggtacaggaactcctaagaattgcttctcatttttactattaaatgattatttgaaagtcaaaacttaatattgcacttattttaattttttgaccagttctcccaaatcagtgtcttaaagattctgctttaaaaataagtttgccaaagatgtgttttctttttgttggtaaggtggcattgctgagaatctagcagagaagttgattggtgttctctttgaggtgtggttactagcttgtactcggtgcttcccaacacctccttattggaaaacagccaaggagatggtggctaactggaggcatcacccagcagtggtggagcagtggagcaaggtcatttgtgcactcacttccaggtaggttattgtcattgccctgccttccttcacctgtctgaccttaggcagctttctggcattcatggaatacattataacaaaggctgggtctgttattactgtactttagatacagaattgagccactttttaaatatagatataacagtttggctagtgcctgtttaaaacatttcagaataatcaagtattcttgagaaacagataaattttataccctacttcccccacaaaaaaattccactcttattttgatcattaaaatatgcatgatcattaaaatatgcctaatcattattttaaagaaacaaaccatagaaagatataatagaaaagttctcctgaaatcctaccatgtatatttatatataattttacaggaatgggaccatattatacatgctactttataaccaaagtaggcagtttttttataataataattttacctttttgccatttatatttaataccatcgctgttttataagtacactcttaggttcatttttttcagacttattttttcatttcaatcgtgattttaatatgcaagcataccttgttttattgcacttgactgtattgagcttcacggataccatgtttttttttttttccaaattgaagggttgtggcaaccctgcatcaagcgagtctgtcgggtgccatttttccaacagcatatgctcactttgtgcctctgtcatatgttggtaattcttgcgtatttcaaacttttactgttatggtgacctgtgatcagtgatctttaatattaccattgtaattgttttagagtgccacgtactacacctatataaaatggtgaacttaactgatcaatgttgtttgtgttctgacagctccactgaccagctgttttccgtctctttcccactcttgagacacaatgatactgaaattaggccaattagtaactctataatggcctcaaagtggtcgagtgaaaggaatagttggatgtctctcactttaaatcaaaagctagaaatgattaagtttaattaggaaggtgtgttgaaagccaaaacaggctgaaagctaggcctcttgcaccaaatggttagccaaggtgtgaatgcaaaggtaaagttcttgaaggaaattaaacatgctacaccactgaacacaggaatgataagaaagcaaaacaggcttatttatgatatggagaaagtttgagtgggctagataggagatcaaaccagtcacaacattttcttaagccaaagcgtgatccagagcaaggcctaactgtcttcagttctatgaaggctgcgagaggtgaggaagctgtagaagaaagcttaggaagaggccgaggttggttcatgaggtttaaggaaagaagccatgtctataacgtgaaagtgcaagctgaagcagcaagtgtgatggagaagctgcagcaagtgatccagatgatctagctaagatcattgacgaaggtggcctcactaaacaacagattttcagtgtgcattaaacagtcttgtattggaagaagacaccatctaggacttctatagctagagaggagaagtcagtgcctggcaagctgaagccagtgctcatttaccatttggaatatcctagggcccttaagaataatgttaaatttgcgcttgccttggcagcctatatactaagaatgatgttaaatttattctggctgtgtgcagtggctcacacctgtaatcccagcactttgggagtacgaggtgggcagattagttgagctcaggagtttgagaccactctgggcaacttggcaaaagcccatctctacaaaaaatagccaggtgtggtggcttgcgcctgtagaacacacctcccaggttcaagtgattcttgtgccttagcctcccgaataactgggattacagaggtgtgccaacatgtcctgctagtttttgtatttttagtagaggtgggggtttcaccatgttggccagtctggtctccaactcctagtctcaaaacaatccacccatctcagcctcccaaagtgcttggattacaggcatgagccactgtgcccagcgtgactttcaaatcttaagaaatacagctgaccattgaacaacatgtatttgaactgtgtgggtccacttacatgtagatttttctcaattaaaaatagtggaaaattttttttgaaatttgagacaatttgaaaaaatgtgcaaatgaaccgtgtatcctagaaatattgaaaaaattaagaaaaaattaggtatgtcgtaggcataaaatatatgtacatgctagtcttgtatcatttactaccataaaatacacacaaatgtattatactaaattaaaatttattaaaacttatgcatacaaatgcttatagactatatacatgataccatttgcagtaatgtaaacaataggtaaagaaatgtaaacaaacataaaagctgcagtattaaatcataattgcataaaattaactctggtacatactgtactactgtaataattttgtagccacttcctgttgctattgcaatgagctcaggtgttgtgaatattcactgaaaactccatgtgacactaatcatctctgcttgagcagttaatctcttcagtaaatagtgtatctcagtaaaaagtgatgtctcagttttcatttatttttcgtcatatttaatttacaatactgtaaacctggaataagtaataccatgagacccataggaagtgccaccagtggtgctggaagtgctcccaagaagcagagaaaactcatgacattacaagaaaaagttgaattgcttgatacgttctgttgtttgaggtctgcagctgtggtcacctgccagttcaggcagacaattgactttgtaaacagatgacataaacttatggtatcaataaacacagtacagtgctgtaaatgtaaatgtgttttctcttttatatgatttttttttgtttgagacagtctcactttttcacctagtctggagtgcagtggtgcgatctcagctcactgcaacctctgcctcattgcagcctctgcctcccatgctcaagtgattctcgtgcctcagcctccccagtagctgggattacaggcgtgagccaccatgcccagctaattttttagtatttttagtagagtcagggattctccatgttggccaagctggtctctaactccaggcctcatgtgagccgccccacctctgccttccaaagtgctgggattacaggcatgagccactgcgcctggcccttttttatgattttttttaaagagggggtcttgctgtgttgcccaggctagagtataatggctattcacacctcctgggcgcaagctgtttagattggtgcaaaagtaattgcggcttttgccatattttaattacttttgtaccaacacaatatcttctgcttcaagcctacaagtgtctgggactatgggtgtgctgctgcatctgattttccttatgattttcttaataacattttatttagctttctttattgtaagaataccatatataatacacatacaaaatatgtattagttatttgttattggtaaggcttctgattagaagtaggctattagtagttaagttttgagggagtcaaacattatacatagatttttcaactgtatgaggggccagcacctctagtccctattgttcaggggtcaactgtacattctgtaaggttatagctaccatatcaacattaacaggagtttggaagaagttgattccaaccctaatgaatgactctgaggggttcaaagcttcagtggaagaagtcactgcagatgaggtggagaagtagcaagagaactacaaattagaagtatagcccaaagagatgactaattgctgcaatgtcatgataaaactaatggtgaggagtcttatggatgagcaaagagtttcctgaggtggaatctactcctggtatagatgccatgaacattgttgaaatgacagcaaagtatttagaatattacataagcttaattggtaaagtaatggcagagtttgagaggattgactccgattttgaaagaagttctactatgggtaaaatgctatgaaatggcattgcatgccacagataaattttttgtgaaaagaagagtcagtccatgtggcacacctcattgttgtcttatttttaaaaactgccacagccaccccaaccttcagcagtcaccttcctgatcagtctgcagccatcaatgaggcaataccctccaccagtgaaaagatgactctagatgacgcaaacaaatggaaaaacattccatgttcatggattagaagaatcaaaatcattaaaatggccatactgcccatagcaatctacagattcaacactattcctgtcaaactaccagtgccattttttcacataactaggaaaaaacctattctaaaattcatattgcaaccaaaaaagagctctaatagccaaagcaaatcctaagcaaaaagaacaaagctggaggcttcacattacccaccttgaaactatactagagggctacagtcaccaaaacagcatggtactggtacaaaaacagatatataaactaatggaacagaatagagaacccagaagtaaagctgcataactacagccatctgatttttgacagagtcaataaaaacaagcaatggggaaaggactctctattcaataaatagtgcagggataactggctaaccatatgcagaagaatgaaactagactcctacctttcaccatatacaaaaattaactcaagatggattaaagatttaaatgtaatacctcaagctataagaatactagaagaaaacctaggaaacactattatggacatttgccttgggaaggaatttatgactcagtcctcaaaagtaattgcaacaaaaacaatcgacaagtggtacctaattaaactaaagagtttgcacagtaaaagaaactatcaacagagtaaatggaaaacctacagaatgggagaaaatattcacaaattatacatctgacagagatctaatatccagaatctataaggaacttaaagcaattgaacaagcaaaaaacaaccccgttaaaaaacaggcaaaagacatgaacagacacttatcaaaagaagacatataagtggccaagaaacatatgaaaaaatgctccacattactaatcatcaaacaaatgcaaatcaaaaccacaatgagataccatctcacaccaggcagaatgggtattattaaaaagtcaaaaaaacagtagatgctggcaagactgcagggaaaagggaatgcttatactctgctggtgggaatgtaaattagttccagctactgtggaaagcagttgggagatttctcaaagaacttaaaatacgactaccattcaacccagctatcccattgctgggtatatatccaaaagaaaacaaattgttctaccgaaaagacacatgcacttttatatattgcagcacgattcacaatagcaaagacatggaatcagcctagatgcccgtcggtggtagactgggtaaagaaaatgtggcacatatgcaccatggaatactatgcagccatgaaaaagaattaattgtgtcctttgtagcaacatggatgcagcttgaagccattatcctaagtgaattaacacaggaacagaaaaccaagtatcacatgttcttacttataagtgggtgctaaacattggacataaaactcatggacataaagatgacaacattagaaactgaggactgctggtgggggaagaggagcagtgttgaaaagtccagatgatgggatcatttgtaccccaagcctcagcatcatgcagtatacccagataacctgcacatgtacctcctgaatctaaaattaaagttggaaaattttaaaaagggaaaggattatgacttggtgaaggcacagataaattattagcatctttcagcagtaaaatattaatatttttaaattaaggatgtgcattgatttttaaacatataatcctattgcatacttaatcgactacagtatagtccaaacataacttttatatgcattgagaaaccaaaaaaacgtgcatgccttgctttttgcaatgtttgttttattagggtagtgtgaaactgaacctgcaagatctcgaagttatacccgtataactctagatatagataagggttctttaaaaaatataatacccttatcacacccaaaaaagttgacaattctttaataccggttagctagtcagtgttcaaatttccaggtacaattgaccctctgtgggttctgtatccatggacacagccagtcagagatcaaaaatatttggcaaaaaatttcacaaaattccaaagagtaaaaattgaatttgccttctactgcctgagtactgcatcgaatctgtgcaaatgaagggatgtgtatgcattgtattaggtattataagtaatcttgagacgatttaaagtatataggaagatgtgtgtaggttatatgcaaatactaaattattttatgtaagggggcttgagcatccgtggattttggcatctgaggggtgttctgcgtcaatcccctataattctgaaggacaactgtataggttcctgcttttttctttcctttttttttttgacagggtttcttactctgtcacccaggctggaatgcagtggtgcaatcacagcttactgcagccttaatctcttaggctcaagtgatcctcctgcctcagccacctgagtagctggaactgcaggcgtgcaccaccatgcttggctaatttttatatttttggtcaagatggggttcctccatgttgtccaggctggccttgaactcctgggctcgagcagtcctcctgccttggcctcccaaagttctggtattacaggcctgagtgaccacgcctggcctaggtttctgctttatttttctttgcaatttttttgttgaagaaactgggttgtcttacagagtgtttcacattttggatttgtccacattgttaattactatattcctctgccccgctgtatttcctataaactggtagttagatctagagacttgatctcattcaggtttgatagggggcaaagagagggggtgacaggaacaaaaactttataggtagtgttatgtatcagaaggtagacttctctttttctgagttaatgtttagatctttattattatttaaactaaaaaatgaagctttggaatattttgttaattctagtatatcacagagaacatgaatattatgaatctagccatgagcggtggctcacacctgtaatcccagcactttgggaggctgaggcaggatgattgctttaaaaaaattatgaatctgtttttaagtaatgcttttatcttgattataatcacagtacatgcttataatagaaaatttggaaaatgtagggacagatacctatcattcagagccaacccatgttaacattttaatgtattttttccatttagttccctttttaaaaatgccagtttgaaattattctatataatattatctacttttttcatttgatgtctgattcttgtcactttagttacacaaactttttctcattaaatagctgttgagatcatatttttaatggttttgtagttttccattatataattggaattataattcatttaataatttccttgttattgttgttgttatttttgtttttttgaggcagggtcttgctttgttgcccaggctggagtacagtggtatgatcaggactcatagcagcctcaacctccccaggctcaaacaatcctctcacctcagcctcccatggcagctgggagctacaggttcatgccaccacgcccagctaatttttgtattttttgtaaagatgaggttttgcatatcgcccaggcaggcaggactcaagctcctggactcaagtgatccactagacttggcctcccagagtgctgggattggagtgcaggcgtgagccactatgccagcgttgtttttttgtttttgtttttcttttttttttgagatatggtcttgctctgttgcccagggtggagtgcagtggcgcagtcatggctcattgtagcctcgaactcctgacctcaagcaatcctcccatcttcccctgctgttttgatatttatgttgttcccattgttttattttaaaaatattggtgatatgaatgctttatacatagtctttatatgtgagaatattatctctaggtagagaataattgagttaaagggctttgaatagttttaatacatttagaatattaagtaattaagttgttgagttatttttatggtatgtcataaattctaaacttcatgtaaaactattataacttagttatatggcagaaatttgcagtgagatgaatcttttaaaaaatttacatattgtatgattatataattatataagtataattacatatataaatagctataatttataagtaatatgcaatgtgtatatgtcaaacatattacatataaacatataaatgtcacagaaagacatttaaaaactaagatcactgacagctgaaaaacacaaactataactacaaaatgggaagaaatgataaaaaatgattaacatacctaacctataaaaaggtcataaagaataattcagaatcactgatacacaagtagaaaaattaggctagtcaaaccagaaagagaagagatgcaaggaaaaactttaagaatcagtttacaacagaataaatgtcccacagagcacatggatgggcctggaagagggacaagtaaaaagtgatgaagctgaactgaagagaattactatataaaagatagggacagcaggaagtaacagtattttaatactaattattttaaattatttaagtatcttaaataatttaaaacactctttttttggtatacttgtttattttacccaaaaactcatgtatcttgtaaagaagatgctgataacaacacgtgtattacatataaaatatatacaacagcatatactcttcttcccagcttctttccattagaaatcatcttgaaagtctccaatttgttttcaatgtaaaacttctttttaatgaacgcataatagttgtacatatttgtggagtacataatgatgttttgatatatatataaaaaatgtgtagtgattgatcagagtaattagcatatccatcatcccaaacataaaaaaactagaaatcctctttcagtttgtctgttttataaatgagggtttccatatgtcttgttcacgtatgtgaggtacacatgtttcatccattttctctgtcttctttctatgcttgagtgtatttttcaatctgttaagaaatggactcagtggtgtgcatttattttctagattgctacgctttacatatggtccttcatttcctgcatttaaagttcccgatgaagatgccagtctgatccctccagaaatggataatgagtgtgttgcacagacatggtttcgctttttacacatgttaaggtattgttattttattatttcatgtgccatttacctagtaagtatcttagggcaggaatcatgctgtaagtctcttgtttgaattcagaaggtggacactaagccccattcatcaaatggaatccagctggacaacaagcacatttctgtcctgtgcctcctgctctccccgtcccagcagggttaggctgtcctcagccgctcttggtttacacgctctaggaacgcgttccctgtggtagatgccgcacttgttctcttgcctgttactgcagccaggctgatgatctttctcttgggattttgtcacattctgtggggactggaggttgccttgctcctctctgtgcccagcactgactggtcagtctgcctctcagagccctcctccaatagcctgtttaaagtttcaatgggagatacaccctaaaatttcacagaggggtatactgctacttcctgctgtccctgtcttttatatagtaattctcttcagttcagcttcatcactttttacttgtccctcttccagccccatctgtgtgctctgtagaacatttattctgttgtaaactgattcttaaattttttccttgcatatcttctctttctggtttaactagcctaatttttctattttgtgtatcagtgattctgaattactctttatgacctttttataagttaggtatgttaatctttttttatcatttcttcccattttgtagttacagtttgtgtttttcagctgtcagtgatcttagtttttaaatgtctttctgtgatcattttctatttcctttgtgttctttgatcagatagtcacctatgatttcttccaatgttgtttcctttgtaatagtaagttcttttatatacctcaggatctgtctttatatgtatataaacacacacacgcacatacacacacacacacacacacacacacacacacacagacacacgcatgcatgtaatttgcagagatggggtcttcctacgttgcccaggcggtctcaaactcctggacttaagcaatccacccacttcagcctcccaaagtgctagggttacaagcatcgagccaccgcacccagcctggaatttgtctttagttcacatattactgcattaaattcatttgtttttatatcagattcacactcttattttaactttataatatttactgatatttagtaggtctaatgtctttttctctttttccttctcttagaatatttatctcttcttgcctgtttaacatttcagatcaattttagaaccaatttttcaagttacaaaacataagcaaacagaaggaaaaacctcaacgaaaccttctggggtttggattgtgtattatttagggtaaggaatatgtgctgctttagcaaatgaacttgaaaatcttttatagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggggtgaacccgggaggcggagcttgcagtgagccgagattgcgccactgcactccagcctgggcgacagagcgagactccgtctcaaaaaaaaaaaaaaaaagaaaatcttttataaagtctggagtcaggactggctctgctcacatagtcgttcagagacccagctggcagaggctctttcatcttcaacagatgactccattagggcctcagtgttataagcaggattctcgtatctggctagcagatggggaacagagagcaaggaaaattttgtgggagggttttatgtgtcaggccttgaagtaatataaatcactgttactcatattccattagccacaactcagacacacaccacacttaattgcaagagaacagagaagaaaagagaaagtggtgaacagctagccagactctgccgaagatgagaattgtattaagcttgtatttatatttaggaaacgctgatatctgatattgagtctgcctttcttttttttttttttaatttttttagtatttattgatcattcttgggtgtttctcggagagggggatttggcagggtcataggacaatagtggagggaaggtcagcagataaacatgtgaacaaaggtctctggttttcctaggcagagggccctgccgccttccgcagtgtttgtgtccctgggtacttgagattagggagtggtgatgactcttaacgggtatgctgccttcaagcatctgtttaacaaagcacatcttgcaccgccattaatccatttaaccctgagttgacacagcacatgttttagagagcacggggttgggggtaaggttataaattaacagcatcccaaggcagaagaatttttcttagtacagaacaaaatggagtctcctatgtctacttctttctacacagacacagtaacatctgatctctctttcttttccccacatttcccgcttttctattcgacaaaaccgccatcatcatcatggcccgttctcaatgagctgttgggtacacctcctagacggggtggcggccgggcagaggggctgctcacttcccagacggggcggccgggcagaggcgccccccacctcccagacagggcggcggccgggcgggggctgccccccacctcccggacggggcagctggcgagtctgcctttctaagagcatgtctttttctttttttagaattttgcgtatcttcttgaaatgttttacagttttcttcacaaagatttttaatattttctttaccattatttctaggtatttgttgctgatgttttgaaaagctaactcttttctgctattctgtcttctagatggttattactgctgtaaagaacattttttactgcatgttattttgcatattatatatagcatttaaaagagctctgaatatttcactgattcttctgagatatgggcacatatctgcaaataagaagtgtctcttttctaataattcatacttgttttggtgactaattaaaagtacttcggatgcagtaagacttggacctgacttaaattctgctagttttttctttgtgaacttgagcaatttattctctctgtgcctcagtttctttttaatctacataatgggaataatgatagtaccatctcgttataagtattgaagaagaaaaagcatgtaaaacggcatgatgcctagtgcatggtaggtgcttgaaagttgctattattacagttatttctgtatattattttactgcatccatcagaagtagaacactgttgaattaaagtgatactgttttggcaccttttttggtctgattttcatcggaatgcctctgatatatggaattttgagtaggatgttggttgttgatattagatgttcttttttatgctcctggtttcctaagcagttaaaaattttatttatttttatttatttattttttgagatggagtctcgctctgtcacccaggctggagtgcagtggcgcaatctctgctcactgcaagttccgcctcctgggttcacgccattcttctgcctcagcctcctgagtagctgggactacaggcgcccaccaccatgcctgactaattttttgtattttttagtagagacggggtttcaccatgttagccaggatggtcttgatctcttgacctcatgatccgcctgcctcggcctctcaaagtgctaggattacaggcttgagccaccacgcccggccagcaattaaaaatttttaaaaatataggccaggcacggtggctcacgcctataataatagcacttttggaggccaacgcgggtagatcacccaagcttaggagttcgagaccagcctgggcaacatggtgaaaccctgtctctactaaaaatacaaaaaatgggctgggcgtggtggctcacgcctgtaatcccaacactttgggaggccaaggtgggcggatcccttgaagtcaggagttcgagaccagcctggccaacatggtgaaaccctgtctctactaaaaatacaaaaattagctgggtgtggtggcacatgcctgtaatcccagctacttgggaggctgaggcaggagaatcgcttgaaccgggaagcagaggttgcactccagcccgggcgacagagcggcggcggtggggggtgggggggaagcaaaaaacaaattagctgagtatagtggtgcacctgtaatcctagctactcaggaggctgaagcacagggattgcttgaacccgggaggcagagttgcagtgagccaagatcataccactgtactctagcctgggcaacagagcaagactgtctcaaaaaaaaaaaaaaaattaaattaaaatataaataaactatagtaccgaattgtttcgaataatatttttggatccatttaagcaattaagtggtttttcttctttcatctgttgatgtgaaatattaattaatttcccaatgttgaaccatctatcattcctgaaagaaaagttttgcttggttatggaatgcttttcttttaatgtttttctgaattgtctgtagttctatcttttcatgaattggataggaaaactttctgtccttttttatggtctgttgtgtcaaagttttgtgttccttaagagtttgaaataaatgaacagtaaaactctagtcgagtcttttttagaggtagtacttagatagtctttcttcttgagctgactgtggtactttagtcagagttattttggatggcaaaaagaggagccaacttaagcaaatgcaggtgagaaaaagagattatgtgaagatagagcagtcttactaggctccatgaagcagcgaacaaccctttctcatgttggggagggatgaaggcaacctcgggacaagccactctgtcatttgtttctctttgcttttttgattctcttgtgcatgcacattgttctttctccagcaggcttgctcctgggtccctttttcctcctgcctttgagagggggacatgcagtctcttgataactgcccagtggtgtaaatagctgtgatactgtttgacttcagtgtttgtcctttcagttcacgggggctttccctttgcttagtttctccaaagggaaaattggatcaaattatcttcgttaattaggtctctggcaggcatctggatacctcctttaggacagttttacctcctttcttaaatgagctgcgactgggtagaaggcaggtcatgaggattttttatgattgtgattatttgtgattgttggcagatttcctaggatgaaggttgaatatgatggggagataggcatcaacattttgtcttgtgtgttagtgatttatctttttccaggaaaaccaaaaaatatttttcatttttgtttccatactgttgtcaaatgcttgtctttggacttgtgtatgcccacctgccctttaggccccatctggagattgtttcagtaaatttaggtctaatctggattttttaacaggttccccaaatgtgtcaggtacacggggcattgggaactgcaggaatgcagttgcttttagtttttcatatcctttgttacccattcttatttcaagttttacttactttcttgagtctgttctctaaatatttgggagccaataaaatcattcctggtttacctctggagaagctggtatgaatctttctctctccagtttttgatttacagtagacatgaatttagccaagctctgtgggacttaggtgtagttccatttcagctttactccttgttcttctaatttctgaatagttgaactacagcccccagcaggcactgctgctggagacgaatctcccttcctctgtcttacttggtggactagtccagttctatggaaacagtgtgctaccactggaagcccatttttcttacatgcacacacgttctcctttccgcaattacagttacttgaaattaagtcttttggtgggtggaaaaagaggttttgaaaggcagagcatgtatagatcactgattcctatttctcagcctagttcttttgccttgtagctagtggaaattctgtttaccggctttagattatcagtattactttgaattggagaggctttttaatggaatgctaagcagaccatttgagtgaaaaatcataatctgttttttaatggaaatatttcaaactgtttgtacataaaatgtaattcaaacacaaatacaccgttttgaaatttatggctttagtacatacacatgaacacaacataaaactattaacactaatcctgattttcaaatatagttgtttttttttaattgaaaatgttaatattaaagtaaaattttctccttggagcttttgttgacatatttatagctttaccattccattgctttttctttttttctttttttctttttttcctgagatggcatgttgctctgttgctcaggctggaatgcattggcatgatcatagctcactgcagcctcggccttgaactccttggctcaagtgatctgcctcagccttccaagtagttgggaccataggcacgtgccaccatgtccatctattgcttaattcttaacatattagaaaaagcatctatgtatactctcaaaattaaaattttttctagtcttactttgattctcatgcttggagtaggcaatgttcatgtaaccacactgcagatcttctgtaaagaagtgttgagatttgaatcgctggcccattaaatacaaatcagtctcttttctgaatcagagaaataggcacagtcctattcttaaattagattacgtgtattttattgctatagaaatttctaaatttgtgattaattctttcctctcttttaatagtaatcctgtggatttgagtaacccagctattataagctctactcccaaatttcaggaacagttcttgaatgtgagcggaatgccgcaagaattgaatcagtatccctgccttaaacatctgcctcaaatattttttcgtgccatgcgtggaatcagctgtctggtggatgcattcttaggtgaattttgtgtatgttgctagatgtatgaagagcttcatttagataactctagaggctaaccctaggagttattagaaaacatccgaaggaaaagatgaacagatttgatgacaaataacaagcgaggaaaaattatttgcaacaaataaaatagccagagggttatcgtttctatgtaaatatttagattggtgcaaaagtaattgcggtttttgccattaaaagtaatgcggccaaaactgcagttacttttgcacccacctaatacatcaaacaaagtgctaagaacaagaattaggcctagtagataaatggacaaaggataagagtaaatgattgcaaaagaaaagagtgttcatgcatactagctatccaggaaaatacagatgaaaatgcatttgggaccattctcatgtatatcattaaaaagcaaattatacctttagtgagccattcttttaagctgtttttcacattttagatatatgaaaagtcaattttttaacctgttgaaaggcagtgatttataatattttctaaaatatttatgtatacttattaatgtacagttaatatgttagctctgattaagtttggctgccacgtaacaaccaaaaatcctattgtaaacaagatagcttattttcacatatgttaaatctagggctaggcagtgtaatggttccatcaccagcagggatccaaggcccttccatctggtggctctccattctttgcacagtgcctcatgggccatgatggttgagtgagttccaaacatcctgtccaggaattaggaaggaaggagagtctgcatataattggtcctttaagaagatctcttagaagacctacccaacagtcaccaacttctttatggtcaaaatatggccacatctaggtgcaaagggagtttgaaaattgagtcattttttttctgggtagccatgtccatctaaagtttgtgttctgttactcaggaagaaatagtgagtagatactgagaggcaactagcaatctctgctatagtctatgtgtcccaagccttcactaggttactgggagaaattttctgatcatatattttgacctatgaagaataatttcatttgtcttttttttttttttaaggtatttctagaccccgatcagacagtgctcccccaacacccgtgaatagattaagtatgcctcaaagtgctgctgtcagtaccacccccccacataaccggaggcaccgggctgttactgtgaataaggccaccatgaagacaagcacagtaagagtttacatcaccattgttatgctatataaggttggctttttaatctgccattctttttataaagtcttgctattttctcagacttttcattggtatgggtgtattcttgtgttcgtctaataggttagtactgctcatgcctctaaagttcagcaccagacgtcctccacctctcctctgtcaagtccaaatcagactagttcagaaccccggccactgcctgcccctcggagaccaaaggttaacagcatcttgaatctctttggatcatggttatttgatgcagcatttgttcactgtaaacttcataatgggataaacagagacagcagcatgactggtaaatattactcaagaaatatgttatcattattttccttttcctttttctttttctttttagtctttcctacctgcaagattaatatgtatcttaaaaagctctctgtttctgaccaagcaatgtcttgtgcttaaccccttccagctgaagtaacagaacttaagaagttttcctccctgttctttttatgtatgttctatgaggtttggccttttgtctggttttattagacatacttaaggttagtcacattttgttgaatcagatttctttcagtaggtgacctggaagttcccttcatgtcagccaggataataaaatttatataaagaattaaaaattcgaactggaaatttacaagaagtgttttcgattttgacagccattcactcattagtatatgtaaacatcagaaaatttttgcttcacactacactctgacctctcaaattttagtctagagaactttatttcaagggcacactttcaaaaatattatttgctttttaacttaataaaattgattggtggagaattaataactcaaccctgatatcttcatttagattttattataaaaaggaaactgtctaagagctggtggttttttttgtcatcttaactattatatttgaaagtaatggcatagggtgcaggatggatgggtggggtagggcacaatgttttgaatatttataatatgtcttagagagctgaaaaatgacaatggctggcatttattgagctgctgttactattggccaggtactgtgatatatgcattaatgagtgtattgattgtttggtaagaaaccactcttctactggggttggaaatagatcaagacaaaaagatgtctaattagtttatgtatctctagggagactgtcagttccaaggataaaactaatacaatgaccagaagggtctctgctttctctcagaaatgaattcttagctgttactataattcttagctattattattatcatctcagaactaggatctatgtctgtgaacattatactcgtaattattttgaatattcttacaaatctttaatttagaaaagttgtgaatataaagatttttgggaatataatttgagaatgccatggttgagtttagggatgtctttgcttgctttattttgttcaaattcagacactttatattcttccattttcatattataattttatccacaatttgaaagtagtgcttctgggataggtaaatgtgcttacttacaataagtgaaaactttaaaaaaatgactattgggttattcttgtctttatgttcatgtaccttgtattttgagttttctgtaccatgtttatatttattaatttgcattttctagaatgaatcagtcctatttttcttttttctttttgttaagatgtaattcttacaatgtaacttttgggtatagagctgttgacactgaaatctgtgaatctagaatggctcaacctgttgcttggttggtgggcttgcttaaagggaacttatagatctttttgctctccagggagtttgtaacagctttgctcaccctcttgcaccagaagataaaaaccagacttcaaatcatacgtgaacaacatcttactttaaaatttttccttgctggggagaggatagaagctccttttctcctcattgtgttcagagatgataaaggctgttacattacccaggagatatgaggtgtccaaatagttaaaggggttagaatgctaggtgccaatcttgaggtctcaagtctggtgggaggcatgggtatattaactgttttttaagtactggctgccatcaaggaattctgccatgcagttcacctctaacttaaagtgtttgcttctttgaactggttagcttttgatttacatgacagtacactgtgctttgtaaaagtaacattgagctgggaagggttaatgaactaaaattttaatgcacgttatgggcacttcaaaacctcagttctttgtagttgtgtaattttcttcgttcattgttttgcatgatacaaaaatcataattttggacctgaatgcacaatttcctatgtttttgaactagcttgtggtatcgtaaagcttttaatttaacttttaaaaagctaaaaagcttcttaatttattgtaaaatttcaccatctttaaagtattttataattactactgtcctttgatttgtttccatttatttctattatcttgcagcatcttttatccaaattcttctttcttataaatcttgtaagtaggaaccagaagcttctccttaattgcagtcatgtttttatttttttcataattccattaaaaatttgattgtcattgtctcttgtagtttttgcacttgggaagaaaaatacttttctgtgttttgaatggggaagattgttggcaagagcaaattaatctgcctgaatcagtcccattatttctgtatactagtctggtcatgtcatgaattccaggactttgcactaactgtgttttggcttttttttttttttttttttttaaagctttaagcttatttttatacagatttagtgtttgatttgtatgcattctgcatgtagtgtttttcaaatgtattattgctggatagcttatttaggactaaaaatggctcatgggaagttgcataaagatttatgcttgactctgtattctattaaatctattataaaataatttaagcatttcatgtagagtaataaaagatttcagagtgattttcaatacactgtgaaatcttttgttaaaaataaaagcaactttcaaagggcttctgtttcagtgataacaaatgaccatgataatcttttttatcaatccaattttctgatttatcagcctcaagttagctgctgtctgtggttgttaaaattcattctcattttgcttggttgagcgattctttggtgtgtgttttggagttgggtgggtggtgggaatgctctctttttctccctgcccacttctcatccttactttgccctctccctaaagtatacagactggcatagggttgcccatttaattaggatgtccatctggggtaatgtgtaaattgcagtagctatttttcttaacgtttaagcatcattctgtagggggaagaaaaaacagaaaagaaataatagaaaagccaaattctgtattatatatctgtatgtggatacagatatatacaaatgtactctgctgatcaaaaattcagttgaaaaatgcttcttgtaccatctgttaaactgacaatgccactgtaaattaattgtaacctattttcaaagaagatttcagagagccctttttaaaaatattaagacatagttgctaaacaaaagcacttattggattcaagtagctatttaatgacaccaatatttgatctttgtgtccagggtcccatgagcctacgtggcatattgcaaatataataaaaccctccttttctctccccagccattacaacacaagctagcatggagtttcgacggaaagggtcacaaatgtccacagacaccatggtttccaatcctatgtttgatgcaagtgaatttcctgataactatgaagcaggaagagctgaggcttgtgggacactgtgtaggattttttgtagcaagaagactggagaagagattctgccagcttatttatccaggtcttggaatttttgtttgttttttcatttatatagttttgatagtgaagccattgttggttggccgactgaaccgatgagtgatgttggtctgaaatacctacagatgtctgtaagtgatcgacatttgcctgaaatctttcattttacctgtctcatcagatttggtaaagacccttaagaccctttttgttttagaagtgctatttatgtcatcttatttgaatctttttaatatggagagatttcgaaggaccacaattatttgttaacaaatttttagcacagtattcccatgtaggcagtccagaaataagtcagctgtaaatcctgcctccaaggagcttattttctgggcaaagccccaaacaaagccgtgtacacatgtaacaatgatccagcaggaattaggatattgatgggagaggcacagataatgtgctgtgggcattcaggggaagaagcagcgcacatttatttactgtaggggattcaggaaagagttttgggggattaaatgattatgctggacttataaaggatgagtagcatttagcctatgttagaaagttggttagggtcatcttctccaaatctatggcttcagccatctttgttaatgcctctgccatccattcagttgctcaggccagaaacgaagagtcattttagaatcctcttcttctgtatctttagttgatcaaccgatcaaccaactcttgccttcctgctacttaactctctttctgatctctcttttcactctatccccaccattatactttagactttgtcacttttctcctaaattaactcataatggcctcccgttcttcttgacactgttttgccttccttaactgatcattcacacaagtgcagaagtgaggttaatatcaacagagtatttagatatctgcatacttgctaggttctcaggagatagaattaaactgaccctatcagagggaaccaagtacagaattttatagatatgaaaaagaatggtatatacaggcaaataggcagggttatcataactatcggcgcttggtttaagcaacagaaaccctctcaatctgacttaagtaaaaggagaagaagttgtgagaagctagtgatatttattaaattctaaggtcaggaaatgcagtatggcctcatgaagagcagatactcaaggaccaaaacaactttattcctctctctttctctgtcttcctggtctgccagaactgcttcattcttctcttctctgcagatcattttctcttattgtagtgtgcttctgagttcccagttttcattagccgggcatgatggcatttgcctgtagtcccagctactcgggaagctgaggcagaagaatcgcttcaacccaggaggcggaggttgcagtgagccgagattgtgccactgcactccagcctgggcgacagagtgagactccgtctcaaaaaaaaaaaaaagttcccagttttcatggccttggtctaggtgaccatcaggaccaattagtatctctgaattttaattatagactcctgggaaggaggatctaattaatctgcctgtctctggtctagtcagctacagttgtgaaggtgggtcacataagggtgttggagctcacccacttgttgtgggggcatgtttctcaggaactctgggctggggagatatcctaaatggtactttggtagtaggggagaaggctatcaccatgaactttctgactgagccataagactgaatgggtggtagtaggacaaaccaaaacaacagattcatgagagggcaagttattagtttagttttgaatcgattgaatttgaagtgcctatgggatatttatcaacaaatatttattaagtcctactttgtgccagatattgtgcacagaagtaccataataatcactagacatccagatatccagtaagcttttgggtaatagatctggagttcagttgagaggtgtgggttagaatgatttgattatatttagtgacttaagaagtgtttaaaatcaggttagtaaaagagagagctttgagaactaaggttgtcagactgaggaacaccatctttagggggcaggtagagtaagaggacctgtaaaagaaaatggtcatagaaatcagggaagagcaaggagagaagggagtagttagagggctgaatgctttcaaaaggcagaatgagttaagacttagtcatgtctcttggatttggcaatcgagagcccattggttatttgctagtatggttttagttgagttctagggagagagatagattgaaatgggttgagcagtaaccagtaggtgatgaagttgtttctgaagagttttgcagagaagagaaactcacctcacaatagaagagtataacagtgcagctgctgttgaataacgggagattgaatgcttagtaagttgattagaggttgggggtggagttaaaaactaagctatattcaggtatattcctaaaaggaatcttattcaggtgaccttcatgatgaatacagatgatcgaatgcaggtttctttctttcattgtccccccaaaaataatggggaagggacaaaaatgtaaacacacctttttccctaggaattactaaatgttgcaacatttttctcttacggaatttaactcagcagttcccccagtttattgaaaagtactgcagcctgttgttttgttttgttctggttgccttatttgcaggcccctagaactttgagttgcaaggcttaaggtttgagaaggtgcaacagacatgaatttttttttttcttcattaagaaagatgatttgggtcttagtgtatatgattcagaattgttctaattccagtaatatcctttaaagggtaaaattccagtaattccagtaataacttttaaagggtaaaattctaataaattccagtaattccaataatgtcctttctttaaagggtaaaaatagtgatgagtggaaatagactttcagttaactatgtagcaaataataattatgaaaacttttgatcagcagtttgtttaaaatttttttcttgctttcctagattttacatgcttttaattcaaggtttgcagataaatgattatgtgtgccatcctgtcttggccagcgttattctaaactctcctcctttgttctgctgtgacttgaaagggattgatgttgtggttccttactttatttcagctcttgaaaccattttgcctgacaggtaagctatcattctctgctattatatcaactgtctgatttggcctggtctgttggtgcttcctccccagtttcctaatgtatcctgtccagttgtcttcatagtccaagagaactcaggcgacattaaatgagtgtagtgtgtccaaacccacctcatccctgaaatccttcagttctcatttgtctgtgggcttgttgaatcgtttttggcctggtctagaagggtaagaacaactccaacacagaggtcttacctttgtagagtaggccttacgttttaggtaaagaaatcaatcaatcaacttctagtttaattcagtaacagtttaacttagaaatatacaatatacaaatacacaatgcttggatttggaaaaattggcattatatgtatttggcagtagctaaaaatgtgctttagttcaaaaatactaatagctttttattttttggcagagaactctcaaaattcaaaagctatgtaaatccaacagaattgcgaagatcctccattaatatcctgctttctttgttgcccctccctcatcattttggcacagtcaaatctgaggtaatgttttgttaaagtttttttatatcctatattctgttttttgtactaatttaagtcaaatcgaatgttaaaaatgaaacaggagctttttttatttttcaattcaagttatttcatcaagttatttcaagtgaattaacaaagttgacttgtgattttttttttttgttctgtcagtttttctaccagttttcaagcagttataggctaaggacatctattaacatattgttagtgacagattcagcacagtggctaatattagactgaaagcctttctcattatactgatccgttcctccatctagctgttcccacatgggcatcataagctgcaacagctgatgttaaatattatttgttttttccataggtggtcctggaaggaaagtttagtaacgatgacagctcttcttatgataaaccaataacttttctgtccctgaagttgagacttgtgaatatattaataggtgccttgcaaactgaaacggaccccaacaacacccaaatgatattaggtttgtattcacacgttattttgtaagtgaaaccaaagtactgttgactacaggcctgctgaggaggcggcagtcggtaatgggagcctaaacctaatgtagctctacttactctgaatcagaggcacaagttagttttttaatgtaaaaaaatttaaagcagtgagatgagggaagtaaagtgttacagttgtcttggttggtcatttatttgtgcttttgcttttctttctcttctcccttctctcctttctccactctttgcctctccttcccatccctctcttctttcctcctttcttcctgctctccttcctcctgcctctttctcttcctcccgcctcgtcctcttcctcctgcctcttcctcttcttcttgcctcttcctcttactcctgcccattacttacaggtctcatcagtctgcactttcgtcctagtcctttttttctcaaacacatcagctaatgatttcttcagaaccttactttatatccctcctgctggggtgttctttccctagatttttgtttagcttttcttcatcatcttcttaagagagagcttccctaacaatacttgctaaagattatcttatttcatcatttttttcacaacacaaaacctgaaattatcttgtttgcttaaatgcttaaactccccgctttttacatgtttttcaaaatatatcataaggtatttggtgattgacaaatctagtgttagcactaagggacagtcttatctccctgaaaatcttcagagagaccctgatgaacagaggagctcttcttttcttcctctaatctgatgttcaaattgggtaaacagcaatgtattacatttgaaagcaaagggttttcagttgttgcttctgtgtctcagtgccactaaagtgcaatcctgggtattgagatcaccacccttgacagtggaagctcttaggaaagtagggctttcctcagccacctaacaggagtccccactgaaccatgtgaatgcaaataccatcccagcccacaaacctgggtggcagttagaactccccgcttatggagcaattgatctctgaggatgacttgaccttggcagtggttagaggctttctttcttctcttcattagcaagactagaattcagcttcttcctagcatcttagatttttatctgttcaaaagtgggatcagacattccctttaagcccttatgcccccagaggaggtggggtgtatgtccttccaacaggaacacaatccttgaaatggtttctaaaaggcctctaaaactgagggacagatcctgaagagatgggtcacaacggccaagaaccatatttatccagagacacctaattagtaggtgactggagttgtctgtagctgggcaaaaagttttttagggtttcgtaagtctcaaaagccattaattgtggacatgattttctagactcacaaatggagttttttgctctttacattctcagttatgatgtatagctatattcttgttcaggctgggcttttagagaccttctgaagttaatgtggtcagtctgaccaaggtttggaaccagagtctaccagtggcattgataatatctcagatacattctgaacacagagggtggtttatgtggagggggatgttttgatatgtgagaacctccaagttacaatgttttaggttatttaaataacataattttgcttgaaattatataatttctacgattgaagcagtatttggttttgttacacccttgctctgaggcactccctatgtactttccaaggaagagtcagttgttactcttgccataaagtggcaaagctctttccatcttctctttatccatagtgggcaagagtacctcccacggggatgagaagcagtgtgttaggctcaccatctcatttctgtcctagcctttccaggacaatggtttccttgataataaataaatgaagcttacttcagggtatgcagatgtcaacaagccccagactgtgtggctttaatcattcttaaaaagcagtgtggtcagaaagctattgctgtgactttattttgtaatttttgttttatttatttgtttctttttccctgtagaaaaaacagacagtaatgtttgttttatttttaagactagaacctagttttgaaagtattccataatattttccttagtttatattacccttgaaattgagatgcttacatctggtcttttacaccagttaaaaaatatctgataatgagcatgtttttatataaagcaagtttgaccttcacattcattttatttttatttatttatttatttatttatttatttatttatttatttaaatacaagttcttgctctgttgcccaggctggagcgcagtggtgcaatcatgggtcactgcagcccaagctcctggactcaagtgattcttctgccgcaacctctgaagtagctgggaccacaggcgtgtgccaccacacctggctaattttttgttgttgttagaatagggtcttgctctgttgcccaggctggtctcggacttctgggcttctccagtcctccctccttagcctcccaaaatgctgggattacaggtgtgagccactgtgcctggcccacatttattttagggaattttttttttttgagatggagtctcgctgtgtcacccaggctagagggcagtggcatgatcttggcttattgcaacctctgcctcctgggttcaagcaattcttccacctcaccctcctgagtacctgggattactggcacccgccaccacgcccagctaatttttgtattttttagtagacacaggattttaccatgttggccaagctggtcttgaactcctgatagcaaatgatctacctgccttacccttccaaagtgctgggattataggcatgaaccaatgcacctggccagaattaaggaatttttaaagagtctcttctgaccaatcagtggatttattagtagagttgacccttgaacaacatgggtgttagtgatgccaattccctgagtagttgagatccacatataactttttgattccctaaaaacttaactactgatagcctactgttgaccagaaaccttacccataccagttgattaacacatattttgtattttatgcatattattaatatatactgcatttttacaataaagtatgctggagaaaagaatattttattaagaaatacatgttgtaatcccagcattttgggaagctgaggtgggtgactcacgagaccaccctggccagcatggtgaaaccctgtatctactaaaaatacaaaaattagcagggtgtgatggcacatgcctgtagtctcagctacttgggaggctgagataggagaatgtttgaacacgggaggcggaggttgcagtgagccaagatcatgccattgcactgcagcctgggcaataagagcgaaactccgtctcaaaaaaaaaaaataaaataaaaataaaaataaagcttgggcgtggtggctcatgcctgtaatcccagaactttgggaggccgaggtgggtggatcacgaggtgaggagttcaagaccagcctggccaagatggtgaaaccccgtctctactcaaaatacaaaaaagaaaaaaaaaattagccaggcgtggtggcaggcgcctgtaattccagctactcggaggccgaggcagagaattgcttgaacccgggaggtggaggttgcagtgagccaagatcacgctactggactccagcctgggtgacggagtgaggctccatctcaaaaaaaagaaaatcataaggaagagaaaatacatttacagtactgtatttattgataccataaattgtctgtttataagataaatcgtctcaactgttgggcagttgtagctgtagaccccaatctacagtacatatcaagcaactcagctttttcttgtaatgtcatgacttttctctgcttcttgggagcacttccagcatcactagtggcacttcctatgggtcccatggcgttagtcaaggttcatggtgttgcagtaaacatgatgaaaacatgtgagaaccatggtatgcaatttactgcagtgttcagtctgttagagagatgaactactcacatggagatggttagcatcacattgtattttaagcagcatactcattaacacttgagctcaccccagtaacaacaggaggaggctacaaaatgattacagtagtgcagtatgtactacagctaattttatacagttatttaatactacatctttgtttacatttctctggactgcaaatggcatcatgtatggtctgtaagtgtttgtgtacgtaagttttttgataaattttagctttttattttttatttatttttagagacagggtcttgctttgttgcccactctggtctcaaactcctaggacttcaagcaatcctgctgactcggcctcccaaagtgctagaattacaggcatgagctagtatgcccggccaattttaactttttatacttttttaaatatttcttttctttctctttttttttttttgagatgaagtctcgctctgttgtccaggctggagagcagtggtgcaatttcggctcactgcaacctccacctcccaggttcaagcaattcccctgcctcagcctcctgagtagctgagattacaggcgcacaccaccatacccggctaatttttgtatttttagtagagatggggtttcaccatgttgaccaggctagtctcgaactcttgacctcccgccccacttcggccacccaaagtgctgggattataggcatgaaccactgtgcctggccatttttttttttttttaatatttctaggctatgcagtttgggagttttttcaaattgtcacagatctccaaaaaactttctaacatgtttattgaaaaaaacctgcatatgtacagttcaagctcttgtttaagagccaactataatttcatgggtatttcaggaatgctcaaccaaaattatattcttatctgtactattaatcatataaaatgtcttacgcattttagtgttcttgtgtattttatataaaatactgttttattgttgttgtaggggcaatgttaaatattgttcaagattcagcacttttggaagccattggttgccagatggagatggtaagaagcatacatgcaatctgtcagagaatatcacttttgaatttcatgtaaattatattccagaatgtccatctttgtgaattttaaaggcctttggtttgtaaatcctgctcattggctcagaagttttctttttaaaaataatgtatattttgaggtttgcttttcagtgcctcttcagctgtacatcaggttcccgagatattctgtatgagagaaactacagctaaatccagtctttattcctgaacagtgtctgcttaaaactgttacttgttttgctgtggtggcaaacttggttgaataacctaggaaaagccctagccagcaagcaactagtttaactttttcttacccatcaattctttctaacccctctagacctaagtttgcaggtccctcaaagcaccaatgcttccaaatcaaaaatgcttctcagagacttccagtgctctctgctttgtcttcaagatatatcatccctatacttggagtataggcaagacaatggaggggttaatagggtatactggggtaagttgggtagatgtagtaagctgagtagatgtaagatgggtgatcaaattattattacggaaattacattcgtgtctcagtagatggtgaataataatttactgatctgaatataatgaactgtgtttatatggggaaaaatgagggaagtctaacagataggtttattagcccctatacatacgggagttaaaactaaccctagtattgtttgtgttttctgatataactgtatttgaaagttgccgtttgtttattcatgcctttttgttttttgttttgttttgttttgctttggttttgagacagagtctcgctctgactcccaggcttgagtgcagtggcgcaatctctgctcgctgcaaactccgcctcccaggttcctgccattcttctgcctcagcctcccgagtagctgggactacaggcgcctgccactgcgcccggctaatttttttgtattttttaatagagatggggtttcactgtgttagccaggatggtctcgatctcctgacctcgtgatccgcctgcctcggcctcccaaagtgccgggattacaggtgtgagccagcgcgcctggccttattcatgctttttaagcttatatttctgttctgaggttttgcttgggaggcactagggtattctttttaaggacctggaatctagtgaagtctagtaaagatgaaaaagctgggccagccctttgtaaatagtggcaaagaagaccccagtatgggcacttgtagtagtacaaatccttcataccctccagtagatttgtgtgtgtaaaaataccacagtggttttaatcccttgtcaatttctgttactatcagtttgtactattcagttggcacattctgctttatcaacatggtttttaatgattgacctttatttatgcttgtaaactgtgatgtaatcctcacttgattcattttcatttgactagggtggtggagaaaataacctgaagagtcatagtcgcaccaatagtggtattagttcagcaagtggtggaagcacggagcccacgactcccgatagtgagagacctgctcaagctctcttaagagattatggttagtcgtgtttcttttgaaattcaaagtttaatagaatgactttaatgcttacatttataaaacaaaaacattaaaaatgttaatgttcatgttttttatatacttaagtataatagagaggatgtcagtcttaagaagctaagaaaaaacaaatctttttgatttagctgtatagcttttgggtagtatattagatttggggtagtatattaggttttataattgatagtaatgggtgatcagtaaacatttctgaattctctaccatgtgtggtggtagagaaccaaataagatgtggactctgcctcagagctcacagtgtagtggcagagatgtccaataagccagttattgcagtgtggcaaggagggtaatgggggatggattagatagcagcccagaggagagcatgtcttcatgttaaaacctgtgtaccccctactgtagctcactagattctttagccctgaaacatttttattttctgccctgccaagtaaaacatttgccagccaagcatcctatacaaggttgtcccctaccttgggcagttgttttatggattctgtgagtttgtgggtacctttatgtttttctacacaagtactaacagtgtattaaatctgtgagcacttatccagctagattggagtgatatctagattcttagatgtgagtttaatcctttaatcatctggagagttcatgagccatgttcatgaggttcatgaggcatgtcatgagccatgttcatgagttcatgaattcatgaggcatgtttctatggtttaagtttgcaacaagtatccttgaacatgtcagatatacataaagccattatgtggatatttgacacatttaaatattatattcgtgaagaagttatttaaattatcttattcactgtgtatgtagatttaggtattctataggttgaaaattatttttcatgctttctgaaacacatttaagctaaataaatttttcagtactggctgggcgcagtggctcactcctgtaatcccagcactttgggaggccaaggtgggcggatcacctgaggtcaggagttcgagaccagcctggccaacgtggtgaaaccccatctctactaaaaatacaaaaattagctgggggtgggggtgggtgcctgtaatcccagttactctggaggccaaggtaggagactctcttgaacctgggaggcagaggttgcagtgagccaagattgcgccactgtactccagcctgggcaacagagcgagactccatctcaaaaaaaaaaaaaaaaaacagaaaacaaaaacaaaaaaagaaatttttcattactgcatgtgttctaatataaatgttttaagtgattattgtttgtttcagcattttgagctggtgttagtgagctctgcttgtaatgtcgtaaaatattttttactaagaaatcctgatttgtgttagtgtcgcatgagtgtctctctttaatgatcattcctttttctgttgtcactgccctctttctgataggatcgacaggtataatgtccctaaagcttcctttataaattcagtttaatttgtctttatttaatttttcctaatttcctattagctaactagtgattgcttttacatatagattggagcccaaataaaaatatggtggcttggttatttaatttttttagaagtattaaagtaatcctggagaattaaatgttaaagtatgtttgaaaaggcattgcatgtgagttttgatggcttaaaccctgtaagtaatttcaacagatgcttgcttcagagtaattcctagcatctgaggaggccgtaaaattagaactttcctctgtaaagtttcaaggaaataattgatagccttttcatcactctttttgaaaatgtagctatgagttgataatttagaaactttaaattacgttgttatgaaaatgacactgaaactgccaaatcccacggttgtgtcaaagtgcgtgaaccaggaactagaagctgctctggtctagcacatgtgcctgtgcaccgtgtagtcaggcttggcactcaacccagtggggtggggagcgtagcactgtgtgggtgcccgtcgttctcactgtggctgctgtggtctgtgcctagtggatgctgtgcttctcgttactaatgcttagttgttttccctccctgtgggatgtggcattggggttatatcctagctcttaatacagattcagctgctgggctcctgattcgcagcattcatctcgtcacccaaagactcaactcccagtggcgccaagacatgagcatatcactggcagctctagagctcctctctggccttgcaaaggtgaggaagacagtccttttattttaacccaacagccttgggccttggctgttttttctgtatctcttaaccccttgtgtgggtattttagtgttgatcatgctcaaacatagtttatattatatccaaagtgtacaaaatttagcctccaagtgatattctatgcaatgaactttactttttaaaaataggttcaaagagtatgaatgagatttttaccgttaaattataggaaacatttcaatacttgccatttatttatttgcatataatactagaatgcatattgattttgtaaaaaatgattatcctaatgtatgccatttgggattacctgtggctctgccatcctccattatcagagataagtgaaaactggctacacctttttttttttttttttgagacggagtcttgctctgtcgcccagtctgtagcgtagtcgtgcaaacttgttgcactgcagcctccgcttccaagcaatccccctgcctcagcctccaactagctgggattacaggcatacgccatcacagccagctaatttttgtgtttttagtagagatggggtttcaccatgttggccaggctgatctcgaacttctgacctcaggtgatccacccgccttggcctcccaaagtgctaggattccaggtgtgagctactgcacctggccttggctacactttttagatttctttcccagccgttacttcagttttttggaaacttagaacttggtggtcatttgtgcttctctaagtgtattcttttgagatgaaatttgtgtaatataaaattagccatttaaaagcaaacaattcagtgactgttggtacattcacaatgttgagcaacttctacttctagttccaaaatgtttttatcatccctaaaggaaaccccatacccatgaagcagttttgcttcagtctccgcaccccctcctctgacaaccaccatttcatctcaatgggtctacctatactggacatttcatataaatggaatcatacaatgtgtgaccttttgtgtctggtttctttcactaaatgtaatgtttttgagtttcatttatgttgtagaatgtgtcagaactgtattcccttttatgattggataatatttcattgtgtgtatataccccagtttacccatttatcacttgatggacatttgggttgttttaatctctaggctgttgtcagtagtgctgctgtgaacatgtatgtacatgtatttgtttgaataccagttttcagttcttcgggtgtacactaggagcagaattactgggtcatatggtaaccctatgtttaactttttgaggaactgccaaactgtttttcacagtgactgaatcattttacattcccagtgtatgagagtttcactttctttgcattttctctaacatctaggtgttttcttgacagtaagatgagcaggattatcttacatataatatataattgaggaaatacgtaaaatattttgtgaacaaagagccgataaccaggtgctactgtctgggatgatatggttcaaatccttatttttcagttatgggaatagttgtcagaggctgtgacttacctaagctgtaagaaacaaaataagcaataaaacctaaggtgttcttaccaccacttagagcttacctcaaagatcctccaggatggacatcataactttgcgagaagcagttactggtacagaaaataaaaaacagccatttgtgagacatacaggaccacactgtctttgagagcaaggtactgtttcctgtgacctttagtacactcagtagtaagcaataattagtcctaaatggagcactgctctggacctgcctaacaattcataaagggctaacactacctgatttgatgatttactgtaaggctacagtaacacaacagcctggtattggcataggggtggacaaattgatcggtggaagaaaatagtatatccatacttaagtggtcatctgatttttgacaaaggtgcaaaggtaattcaaaggagaaagggtggtcttttcaaccagaggtactataaaacaattggatagtcatacacacaaaaaaaagccaaaaaattttgattcataccttgcactatgaacaaaaattaactcaaactggctgggcatggtgactcatgcctataatcccagcactttgggaggctgaggcaggaagagaccagtctgggcaacatagtgagactttgtctctattacataaaaatatatatataaaacctaaacaataaaacttctagaagaaaacaagagaaaatctttgtgaccttgggatagatttcttaggtgttacgctagaagaacaaactgatatgttggacttcaaaatttaaaactgctgttctttagtaaacactgttaaaagaatgagatgacagatcacaggctgggaggaaatgtttataaagcatatatttgatgaaagatttgtattcagattacataaagaactctcaggactcaataatagcctttccttttggtggtgcacagcagcaatatggtggtgaaaatttctaagaagaggaagtttgatagcatcttcagaaataaactgagcgaattcttcactcagaagcttgcagaaggtgactactctggagctgaggtccaagttatgccaaccaggatagaaatcactaccttagcctccaggatgcagagtgttcttggtgaaaagaaccaccggatctatgaattggctgagatagttcagaagaggtttggcttccttgagggcagggaaagctttatgctgaaaaggtggcctaaaataattctctatgccattgcccagacagagtctgtgctgtaaactactattagggtttgctgtgaggagagccttctgtagtgtgctgtggttcattatggagagtggggcaagagctacgaggtcatggtgtcagcgaaactctaaggacagagaactgaattcatgaacttttgtgtgtgatctgatgatccacagcagagaccttgttaactactgcattgatactgccatccaccatgtgctgctaagacagggtgtgctgggcatcaaagtgaagctcatgcgtcctgggcccaagtggtaagattggccttaagaatcccctgcctgaccacgtgagcactgtagaccctaaagatgagatactattcgccatgcccatctcaggacagatggttaggaagccatgctctacccagccccaactgtgtaatagggtctccttggcagctggatctggagtctggatgttgccttgtaaagacctttaataaaatcttttaagacaacaaaacacaacaacaaaagcccttaataatacaacaaacaacccaattaaaaattgggcaaaagatttgaatagatgttttatcagagatgatatacagatgacaaataagcacatgaaaaaaatactcaatatcattaattattagggaaattcaattaaaaccatgatgagataccactgcaaatctattagaatggctgaaatataaaagactggtcataccaaatgttggtgaggatgtggaggaactattgacgagaatgttaaatggagccaccattttggaaaacagcttggctgttccttaaaaaggtaagcatacacctacatatgacccaataattccactcctaggagataagagaacatttatcgatataaataccttgtacatgaatgtttatagcagctgtatttataatatccagaagctggaaacaacccaatgtccattaataagtaactagataaattgtggtatatccatgcagtggactactattcagcaatagaaatgaatgaacaattgatacacccaaaagtgtagctaagtctgaaaataactatgctgagtgaaagaaaccagaccaaaaaaagtacatattgtatgatctttatatgactttatttatttaaactctagaaaatgcaagctaatctatcgtgacagcagatcagcagttgcttagggagaggggcaaagaggagtgggaggaaggattacaaaggtgcatgaagagatttggaggtgatagatacatccgctgtcgattgtggtgatagttcacaggtgcatacttatgtcagaattgaccagttgtatacttgaaatattgggcaatttatgacaattatgcctctgagcagctgcacagaactttctgcagagcctagtgcatcactgtgaggttgggttaggggtttaaaaatgtgcccatgttctttcagtctctgggaatgatgaacaggtatacccaatgggtttgggttttagggcatgaaaaactatgctaatgaaatactgtttgagcacttgaaaaatgccactattttttgtggagtattacaatacatctgaaataatctgttcctgtatataaataatataaaaaagcaaggcttcctgtagtgtatgacattgtcaaataggtcaagcttcagtgcaaatgctttgaaattggtacagtaattcctggctgattgtttttgttctccaaatgaatatgctcaggtaaaagtgatggttgactcaggagaccggaagcgagccatcagttctgtgtgcacctacattgtttatcagtgtagtcggccagctcctttacactccagggatctgcactccatgatagtggcagcttttcagtgtctctgtgtctggctgacagagcaccctgatatgcttgatgaaaaggtgagtttattttattttaaaccattaagtaaaaacaaaaatgtatgctagcaaaatgccttttgaaagagaatatctaaatttaaatacagtattgcacactttaaactgaaaatacttgttagattacagtggaacacttgtccttttgggtacaacttgaaaactgtcattttgcttatatttggttgcaaattaactcatagagaaattgtttagaaagatgagaccttggctaatttatctgagctatcaagattgttctttcttgaaaggatggtagcctggagatagctagtaggcactttggtcacccttcaccaaacaaagaagggcagatgattgccaggctgcaaacctagagcacagctcatctataaaggttgcttctatcgaaaaatgttactccatactcatttcttcattctcaagtggatgcagataactagtccatgttccctaccattgttctgtgtaatgtcttccttatagggaagcaggtgttataaggaattcacagtgcaaatcaaaggagagatcattggatatttatagaaacctttatgtagtttaaggaataatattgttgattaaatcttagtcattttcattatggcttctgaagttgtaataccagaaattacttaaaaatgtcaatgacaagatttcctttggatattataatatgtcttaaaccatccccctcctttgatagctaagtccagagatggtgtctgtctctctgtggttacactatcccaagcttaactgaattactatttaatctcttagatttgtgcttttgtgatttatagtcttcagtaatttcacaagaaagttgaattgaatttatttatctaacactctaaacaccaaaatttagttctttaatgagaaattggggggagggggtgtaaagtttattatattactatgaagttaatatatatccattaaagaaattaccaagaaactggagcccttccaccaaaacgcaaccactgttagcatttggatggatttccttgtcttctcatgagaaaggtgtgttctaaaaattgatctgcctttcctgcttttaggactgccttaaggaagtactggagattgtggaactgggtatctcaggaagtaagtccaagaacaatgagcaagaggtcaagtacaaaggagataaggagccaaaccctgcatctatgagggtaaaggatgctgctgaagccaccctaacatggtatggaagtgaccgcacagggattgtgcctaggaattagatggggttagcagtgatccatgttgtttcatttccttcctgattgttcagcattgcgtgatgcagcccctttagaatatactttttctccagaaataaaatgggaagaaaatctctattttttttttacgtgttttgtagaccaaaagaaactaggaacttggggttgagagtttgagtcctttttctataccgtttgatgttaattcaagtaatactgtgttagagctagacttactgtaccccctcactttgatagctaagtccagagatggtgtctgtctctctgtggttacactgttagatctgctttccagctcagtggtctgtattctctgctataccatttatattacatagtataggttcattcaaccaagatttatgaactctcttaacaactgagaataggatcttaaagataagtctgatttagtcaccactacgtctaccatcttgtctggtagggaagataaaatatgaacacaaatagctataatattaggtggaaaataagtgctgcaaaagaggtataaataaaatgctggggagttgaaaggagaaaatgaatacttccagataaggggaagtcagagtaacatttcttgaggaaaatgacactggacctgactctgggaggatgggtcaagtttgagctgcaagccagagtacagggtgggtaaaaaggcaccacgactgctgttttgagaattttggtgtagtaaagtggtaaagacagggagtttggtaccttgaaaaagagtagcagagaaagttgagagagtttttgtttggcttgtaagtgagcatactggaaagagggaaggaaggcagcttagccacatttgtggactgaatggaacagttagtggaaattaggtggaaccatagtacacgtggaaagatggggcttatgaaaggatatgtgcagatgaaggctcagaaaatgtaaaagcagaaaggaggagtggcaagttagtgtgggctggggcatcttggtcttagtaaagtagcaggcaaaaccgcttgaaaattcgtgtgtaagtcagcccttaccaagatcccagcatcttctgtgagttcagtggcctgttgcttgcttgggacatgcacagtgaagttggatttgtttctattcctgtgggcttaagtcattcagtgaatttttagaagaatgctttctgtcatttagtcctgctcactatgcaaatgctggactttcggtgacttgatggaggtttggctaatagctagaaaattaaaaaaaaatgtgaatacagctactgaagcatgtgcttatgctgatgatgaatactagaagtaatataagttcagaaagaagaccatgtgtgggccagggtacccttaaaagtgtcatagggctgggcgcagtggctgcactttgggaggccgaggcgggtggatcacagggtcaagagatcgagacctcctggccagcatggtgaaaccccacctctactaaaaatacaaaaattagctgagtgtgatggtgcacacatgtagtcccagctactcaggaggctgaggcaggagaatcgcttgaacccaggacacggaggttgcagtgagccgagatcacaccatcctggcaacagagtgagattccatctcagaaaaaaaaaagtgtcatagaactaaaacttgatgcatgtcttaaagagtaagaaggatatggagagaaaggaggggacatttctcactagaaactcttcattatacaaaaataagcttgctccatcctagcctggatggggtgttctttgagtgcatggctagcagtgaggattggatatgtgctcagggtgagtagagtcttgggatgcttcttctcaacctcaccagtaagctacatggctcatctgtttcgcttcagctgtcttgtctctgctagcagcttgacaaatggtatctccagttttcagtcttaactgtcatcatgaaacgtgtctctaaccagatttctctgttctctcacaattgctgctttatgttagtatcattgctgtttgccagttatgcaaacacagaactttggctgtttctctgatttatctttctgtcattccccatgtacatgagccagtgactgagttaaacagactttatttttgtaaagtatttcctccatcccctccaacctggatagcatcctagtccaggccctcctcacttcttgcccaattgccctattttcgatctcttagcccttcttgttcattttgtattctattgcaaaactcatcatccttaagcacaattttgatcctgctgcttgaatgattgaaaaccttgagtagatctgtttccttccttgttgtctaaactcctcaatctggtttttaagggcaccatctgatcttttccaccactgctttgcaacttgtctgttttgccgttgtcaggcctgacagagcactgtggctatgaactagccatgcttatacctgcttatgctcttcccctgggtttcaggacctcttttttcttcacttggctacatcctccgctgttcagtgcttatagcaaatctatctacctccatggggcctttggttattctgcttctgaagatgactcttttctgtacttccgtgctcattctgtctgaccctgctgcacggcatggagttttatactgtcatgattgtacctggttacatgtgatccgtgctagtgttgtctcgccagtctggggagcacatttacctctttgccaacacagtgctgaacacgtagtagaaaattatggagtgcagattagctggttaggttttttttcctctctgtgtacactaatacaaattcaggattagggctcttggaagtcatttcaacagtccctttgcctgtcacctttaagacatgtgtaccaagttatttagcctctaatttggagattttctaacccccaaggttgcccatttcattttaattgttaaaaacttgatactttacattgagctaaaatctctcccacttctatgcgttggttctaattcatacatttgatcgttaaatcctttttgtccaggcagtagcagtatccagaagcagtcttcatgttctctctggttcatttctgctgttaccttcagttttttttttttttaaatattacaaagattcaagtacctttatcatcctggttattctcaactggcatagatttgactatgagcctcttacaggtggtttacagagtataatactctattattttgtatttttttcttgagacggagtctcgccctgtcacccaggctggagtgcaatggcatgatcttgactcactgcaactgccgcctcccagagtcaagcaattctcctccctcagcttcccgagtacctgggactacaggcacgtgccactacaccctgctaatttttgtatttttagtagagacggagttttgccatgttggccaagctggtcttgaactcctgacctcaggtgatccatccacctcggcctcccaaagtgctgggattacaggtgtgagccttctgcacccagctgagtacagtattctagatatgatttgatgatctttaaactctatataatactacattttcattaaaatgtactcggactgcattgcatttttgagaacttgatgatttgcattaagtcaactaaaatccttgagttttttttcacacgtttacctttcatgtgtttttctcatcctgacttgtttgggagtgtttgaaagtaatgcacagaactttacatttaaacctgaaatttcttcatctaagatttacctcattatttttagtctttaagattcttttggatctcaactctttctatggtatattatctctgcagctctgcttttgggcaactggacatttaatgagcatatcctgtgtgttctaaataccttgataaaaatattgaacagatagactcgcaaagcacatcatcagagcacttccttcaggtccacagggatttttaaatttagctacaagttcatgatattatatgaaatgttatttcatataatatgaaatgggaataataatggtatatgggaataatagtggtacctattgttaggatattatgtgaattgttgtgatattatgatactatatcacataatattataacaatcctatcagataggtaccattattcccattttataatgaaggaactgtagcacagaaagaaaatatcttaaaatgaagattttatcttgtggttctaatatcatctggcccttcatatgcatctcaatgggaagaccagtattctacagcaccacatttgtcatctcaactctcagcttgaatggcctctcctctttcactctaaggtttgaacctaaagctctctaacaatggagagcaacattgctcaacagattatttttcttccatttcctctcctcctaaaacgaagactgtctcagaacttcagggaccaggagaacttggcattaagttcaggcctctaatggtttgcagaaaataggagaaacaccaggagatcaataatgagaaaatatggcttttaaacaccaggagatcaataatgagaaaatatggctttggttttctaaaatgggatagagacggttgtcacaaagcatatggaatatgagcttgctgtgttccatgcaagattctaagatatcagataggttgctggtaagggagtaggtcactaagatcaaattataccagcctaactgcattttctgttccggatattgaccagactggaaaggcagattaaatgtctctgaaataaagacatacaggtatgcatctggggtaatgggctttttaatcttggaggggagagtctggacagcatgccatggcattcaccacaaggagtaaatctgacctgtcaagaagcatggctgtggtcaattaaaattcagaagagtggaaggggacacattgatgcacaaggtaaactgaagattttgctttgggaattaactgttatcttttccattctccatagcattatgcagttgctcggcgcatttccttcacctagtggtcctgcctctccttgtagtcttgtgaatgagaccactttgattaaatactccaggctgccaaccataaacaagcatagtttccggtactttgtcttggataacagtgtcatcctggcaatgctggaacaacctcttggaaatgagcagagtaagtttatagtactttgagccttctctactgcttaatcagtgttaccagtaccatgaagctgtttccaggatcagggaaggacagcctacagattctaagtaggtcagaaagatttctagctgtgggacaatagcacctgaaaaataggggggcaaaaaaatagaatatacatattacatagagtcttttaaaggctcttgatgtgcatctgaactagctctgtagttttataaaaggtggtgttttagtgggttccattgtgttgtttatctttgtcactttttcttcccccttgaacttcggatcctgcccctctgctcccctccctctcactcctcatgttctgtatcaattgttggtgctacctacacaggctagaaacttgaggagttatctttacctgccccttcctgttactcacttatataattagtttctaagtttccatcttcccagggacccttgaatttttcctttcctctgtattttcccaatacatccaagtgcaggtccttattatttctcacctagattattacagctgtttcctacctactctgattccctcaacccctaaaccccttgccagttctaacatgtgttttccctactttcatcctacttgctgccaccatagtattcatcttcaaccacaaatgaccatgccagtgccctactgaaaatccttcagtgattttccattaacacaacatgcactgttttcctcctttccctccccctcagttataagccatctcacaatatgtgattatcactgcgacccaaactatccacaagtacattttttttttctgatggtaattggcatcagccagtatgtaaaagaagcatgttctcagacccttattgctgggaaggggaaggaaagtgaaggttacagaatctgtgggtataaagtgacccatggagtcacctggtatacaattcccttagttatgagtgaaaaaactcaggctcacagagggtatatgacttgcccagggttacttgggactagagcccagattttctaaaccctgtattgtccctttctattattattgtcgcacagtgataggatttgctcagtgattaaagatttgccttcttgcctttgtaaaggtgaagagttctgtgccagttttgttgattatatgagtaagagctcataaatccatgaagtgaaagtgagacatttccctgcagtttgagatgaaaagaataccatcataaacttctgttgtgttgtggtgagatgcggtgacattaatgtgaaatggaatggtgccttttattattgtctaacttcagaactgctactcccaagtcttttctacaggcatctcatccttctctaccctagacatggagcttgcttggctttctttcctagcctgtgcctgttcatgattcctccagcctcctactccaagccatctgctgaggagtctgcaaaatcccagtgtccccttcaggcttcctggcctttttccagctttttaaagactctcctactttcattccaaataatttcattgcataggaagtgtaccaaaaatacaagcaattggaattgtatagatttacaaggacattttaatagtttattgtaataataagaaattatagagaagtttgaaggcgtttgactcccatatctgagacggaagaataaaaaaaaggatctgggtcactcgggaagtccatcctgagtgttttttttaacacccccatcatgtccctgaacttctgctgagatggaacagtgcctgcctgtggtgggcagtggtacacaaaggcatgggcagatataacactaacactgcaaacacccagtctgtctttctacacttaagttgttcccaacattgggaggttaagagtatttactaggacagtgtttcccacaaatgtgtacatgtaccattggaggtatgtgagatgatcttagttgatacattagtgaacattattttatgtatttttaagcatgtgctttaaaattatataattagtacatgccaaaattcatgattttccatttagagatgcacaagagtggttgatacaaagtaatagtacttacagtacacgggtatgggtacggcagaaaccacagaagtggtacacaaaagatcaaagcttaggaaacactgttgggcctttgattatgagaagctctgcagttgataacaagtttattttaaatggttgttgtctgaaattaaaacttttatatacatattttattctagatgattttttcccctctgtcactgtgctggtccggggaatgtctggaagacttgcttgggcacaacagctttgtcttttacccagaggagcaaaagcaaatcagaaggtattcatcagaagttacagggaagtgtgtgtgtgttttgtaatttaaaggttaggtaacattccaacagaagacacagatcaaataaatatttttgatccctagccagattctcagtcagtgggttcatatcagaatcatctaggaacctagaattccagatgtactcaattactctttaaagacatgttcaaggcaggtgtcttttcaaaaagctttccaggtgattctgacatctacttaggagtaattgctgttgtggacaatggccccagttttttccatgtaattttacaaatgtaataaaagtcagatatataccatacgtgaaaaaaatttggtgggacttttgatttgtccgcaacaggacttagtttgaaattgttttatatgatttgttcttatataataattggtaatatattgtataaattttattttttttataaagagtcagggtcttgttctgttgcccagactggagtgcagtggtgtaatcatagctcactgcagcctcaagctcctgggctccagtgatcctcttgcctcatcctcctgagtagctgagactgtaggcacatgccatggcacccagctcatttttaaaattttttgtagagatagggtcttgctttgttgcccaggctgatcccaaacttctgtcttcaagtgatcttcccacctcagcttcccaaagtgttaggattacagatgtgagctgtcacacccagcctaattaaaaaaaaaaaaaaaaatatatatatatatacacacacacacacatacatatacacacacacacacacatatgtatgctgtgtataatttaatgaaatcttttggggtgcagtttattttattacatttgtaattatgtgaataatacttgagaagttggaaaaattcagataacgaagaaattttaaatcacctttactcactatccagaggaatataaccactgctaatattttattggatttccttccctttttttcttttcatacacaataacacttgaatagaatttgagtcattttgtatactgctcttttcatttataacattgtaagcttttatttctgctattaaaaatataaaatgtccaacaatgatagactggattaagaaaatgtggcacatatacaccatggaacactatgcagccataaaaaatgatgagttcatgtcctttgtagggacatggatgaaattggaaatcatcattctcagtaaactatcgcaagaacaaaaaaccaaacaccgcatattctcactcataggtgggaattgaacagtgggaacacatggacacaggagggggaacatcacactctggggcctgttgtcgggtagggggagtggggagggatagcaatgggagatatacctaatgctagatgacgagttagtgggtgcagcgcaccagcatgtcacatgtatacatatttaactaacctgcacattatgcacatgtaccctaaaacttaaagtatcataataaaaaaatgtgattaaaaaaaatttaaaatgtgacttaatatttcactagcatttgagagacaccacaaaattggagcatgtgcctaaaatcatttaatatcttagatgtctctgttagatgtgatgtgtttatcacccagtcctccatttttttggagggggcagtacagagcacatcctgtcatcaactctgtaagccagtaagttagcattgaagactgaagaggaaggggaccaggaaaggagctaaaatttgtttagggttcaccatgtacccatatacatattaaagcatggatttggagctgtgaagacctagatttggtgcccatactctcaattaagccgtattaagattcttgttaaaatcactttctagagatgcccagtgaagccaaacttgtctttaattatattgaatgatgtgagagcccctggggaagagagtttgagtcttaaagctccaaaatgctatacccattggataaccactgaatgtgggagattcaggcctgcagcagtagaggtccacagcccatttgtcagtcattagatctataagaagtcgatgaatatttttagaaaaatagagtacacaggggcacaggctgcttccctttgctgttatctgtagcatttgcaggttctgagtgagtttttgtgacatgtaatcctagggaaacacaggcatctaagagaccagggaaatacatgtcattacagatgggtattggaccctgtgtaataaacataatgttacttgttttaacagctttttgtacctgaacctcgcccagttcctaaaaatgacgttggatttaaatattctgtgaaacatcggccatttcctgaagaggtggacaagattccttttgtgaaagcagatctcagcattccagatttgcatgaaatagtcactgaagaagtaagtacattatttttagctgttgtcaaggggatgaatagaaacattcttacgacttccttggtcaagacaatgcttttagtgttgttggagatgatttttaagatgacatgggcctccatcatccaggaggttgccatgtttaagacgaatatagattgtggctgatcgaaaggaactgcatatctcttagaggtgttgctgggctgcctggctgttcgtggtaggtttcagtactgtagtgacatgatcagactctggtagtagagttatttggaaaaggaagaccagttcagagactattatgagaatctaagtctttataagaaaggaaggactatttcactcatatggaattttaatatataaaatgtattgtggaggtagatccaagcagtcttgaattggtgagggaaggaaaagagccaaagaatttcagattttgagcttgagtgacaaagagatatcagtgccatttacagaaatgcagacattaggaagaggatagatttgggaagatgggaaaaatttatttggctttggattaatttagagagttaattaagataactgtctcttaggtcaagggagaagaattttaagaagtcggggacagaagtatgtcaggacatgagagaacagaagagcaggaatggaggaagggctacactctccaatgctggagagaccagggagaagaaggaatagaaaaagtcccctgaattttggcatgaaatttaggtgacctttgagaacaggtgtgtacagtaggagggataattcaaagggctggggagtgaatgtattgagggacaggcagtgaatagaaactacactgttaacagtaaaggcaagggtacagaatgggtaatattatagcttaaggaaatggcctcgttaaggaaagaaaaggctgatttttttttttttttctgagatggagtttcgctcttgttgcccagactagagtacagttgtgcattctcagctcactgcaatctccgcctcccgggttcaagtgattctcctacctcagcctcccaagtagctgtgattacaggcgcatgccaccatgcctggccaatttttgtatttttagtagagacgggatttcaccatgttggccaagccggtctcgaactcctgacctcaggtgatccaccctcctttgcctcccctcaaagtgctgagaattacaggtgtaagccatcgcacccggccagaaaaggctagtttttaaatatttttttacattcaaggatgtgaggattatgaacatgcttatagattgaaaggaagaaaccagtagagaggagtctggctaacactgtaagatgggcagtgggacttacaagtaatagaggcagtagggtcaagagtctagtctagaaaagagatgcttctaagacagaaggagagagtaggtgaaggttcagagacatttagagaggaaaggagggaaattgaagaagtttatgaaaattttaatcctggttcttggcagtgtaataggggatcccagacagttcttaagaattgccaggcagtgcagctgaggttaagtagcattatctatagtgaagttatttaactcactctgctgactttcttcaaaagtccttgggatctggaagcataagtaaagaatttgactggtgtggagattgacaggtgtggaaatttggaaggaggttcaacacagccatttaatgtgcttaaggagagggtatttagctgttagatgtgggggcttcagtttagttgggaagcagataaagccagaaggatgctaatggagtgggaaagcagggggagggattgagtgccccaccgcaatagtagagcacgagctcaggaagtgaagggataggagttgcacaagggggcttatgattggagagggaatttcagacttacagccctggaaagcagggcacatatcaggttcaagtttgttttcatggatggccaaaattgtgaaggttgaggagcttgtagaattctgagccaggttgttagaaggatcgttactcacccgggaatggaactttaaacaaggattgatcagaaggaaaggtgggagaagtctctaagagtacagtcatgtcatccatacagatgaggaattaaacacagggagcacgtcagggtgaagatggacagtgatctgcaagcgaggggtgagagtgacaactctgccccctttcttgcctatttgaagggaaccagagactgaatgttttcatttacagtgaaaacatgaaggagcaattgttgaaggtatagggaagtttttttggcatttgttttaaccttggaccatgtttgcttaatggcatactctacattgaactgaatcacaatgttgatcactgaaaattatcttcattttctttgttgcttgtagctttattttcattttaaaattaagattgacttagctaggtgcagtggggctcatgcctgtaatcccagcactttgggagcctaaggcaggaggatcacttgagcccaggagttcaagaccagcttggtcaacatagagcccagtctcaaaaaaaaaaaaaaaaaaaaaaaacacttaagattggccttactagtttgataatagtttcaaaaaatgaaatatttggtttattacagttagaagagagacacgaaaaattaaggagtggcatggcccagcagattgcttatgaaatacaccttgagcaacagagtgaggaggaattgcagaagagaagttttcctgacccagttacggattgcaagcccccgcctcctgcccaggaattccaaacagcccgcctttttctctcacactttggatttttgtccttagaagcactgaaggtaattttcatgaacttttatgaataaatatattcacaagttaacattcagctgacaatagctaaaatatttttatcaggatagaagcgaattaaaaaaaaaaaaaactggttaaaattttagcctgcatacaaataaatgaaattctgtgctgctgtaggttatagtttgtgctccaggacaggtcaccccatgaatgcattcagagttctgtctgaggggactggtttgatgatacatctaactctgaattttcctagataacacagtacccatattacacagataaatgaaatctatagataattagaagaagaatgttaaaaatcttcccctagtaagcattattactaaaaatataagctacaattaactttgctctttcatgccacttttagaaaagaatgaagttaatactgtagtatttgtaagtcaagcacttcttatgttgtccagtttgtaagatcaaactgtctggctttatgtcctggaatcactgcttgccagctatgtggtctttggtgagtttctcatcttgtcttagttcctcatcatctataaagtgaggatgataaaagtatccatctcattgatcatgtgaagattaaatgtgttaactcatagaagatacttggtatagtacttagcacaaagtaagccagcctataagataaatattgctattattcttaattccattagccttaaaacaattttacagccaggtgcggtggcttatgcctataatcccaacactttgggagcccaaggcaggaggatcacatgaggccaggagttcgagaccagtctgggcaacatagcgagacccccccatctctatgaaaaattgtttttaaaaattagctggatgtggtggcacacctataatactagcttctcaggagtctgaggcaagaggattgcttgagcctgagagttcgaggttacagtgagttatggtcactccactccactccagcctggttgacagagtgagaccctgtctcttgggaaaaaaaaatgtacaagacaagtgatgcaattcctgttttatagatgtggacatagaggcttaaatatgtgaaataacttgtctggaggtggacttggaatttactctaagtcctgtttgttttgaaaagtacaactgaagattgccaagcaagaagttgcttattgcataacttgtcccttgcccttactgcctaggaactacctggttataggccatttagctttgtaggaaagtaatggggacattgctgtttgattttgtatttcagcatgtagcgggaaaattttttttgtatttttgtattttttttgtagaaaattgagtttgatgcagcatatgaacataaaaacttaaaatgcagaataaaagagcagagagaggaaaattataagaaacatagtggtaaatatggaaggcaaggaaaaaagacacaacttgcaaatcattagtgatattcctagtggagaaaattgaacagagtagaagcagtaaataaaaatatactagaagaaaattaatgcttcctatggacttcagggacacaagaaaggccctaatagccttgtttctgagattatagttttccacttctgttatctgttctagttgaaacttaagcttttaagaaaataattatcatgctttctcatctgtatgagaacataggaaaaataaagttacctggtttatgaaccttagaatatttctaataacttaaacctgacagctcatacatacagaactacaaaccagttttacttatgaatgtatgtacaaaagtattaaagggaatgctaagcagacttagttctgaattaatagcatgttaagtgaattgttttccatgatcaaataaggtttatcccaggaacttagcaattaattaccaggaaatattaataaagctattaagaaaataatttggtcccattagcagttcagtcagtgaaacagtaagtcagtatttactagaatcatattctgattcttaaaaaaataacaaactaagccagcactactagtgtaggttcttactttaaaagattcctctaatgaaacccaggagcaaactagaggaatcttttgttaaaatcagaggtaaaagttatctatcttgactactatttaacaaagagaattttttagtcaatgacgttttttaaactttctagttttaaataattatagattagcaggaaattgcaaaataaagacatgaggaccttcctgcgatgataaattcttatataactacagtacagtataaaaatgaggaaagtcaatgaaatgttaaactaagaggtaaaaatcattggaaatgagaagacagtttgtaggtagtatgacttctagtttgacaaccgtaagaaaatcaataaaatatttaaaataaatgagacttaaggttgccatacaaaaaagtacaaaaattaatgattatgtctatgatattcagttaaaaatacaatgcaaaaatgccccatttacagctgtgatattgacaaaagttaccttaacaaactatgtacaagacctagaggaagaaacttttaacaattattaagagatataaaatatgtatgagttatgttcctggattagaagatcacacagaagaacaagctgaggaaataccttactttaaaaaaaaaagaagaatggggacattctgatctacaaggtgtattgcaacatgcttcaggtccacagttccttttccatgatttcaacgtaaaaactgaaaactggaaaattttttatatatttgtagtaaattcatttagtggcaaaattggacctgaattgacatgaggctgtttgtagttttatgtcacttagtgtgaatacacttatgtttgactgcagaaatattaatgtcttttattagaatattgccctagaccttgctaggaatgttatgtaattgactagaaggctagactcacaatccttgtcagtgtgaaagacagtcattcttgctttctctggaggatgctttcctgaaagatatactatggttagcaaaaccttgtttggcaagatcaagatctcaaagaagataggggattaagaggaaaacaaaacaaaaatgcatttttgaaaaatgtgtagacttaatttttttagagaagatttaggttttcagaacaattgagcagaaagggtagaaagctgtcatacaccttccccacagcccagtttcccctgttatcaacatcttgcattgatgtggtgcatttgttgtgactgatgaacctgtattggtgcattactcaccgaagtcggtgatttacaatagggttcactctgtgctgtacaggtctctggggtttgacaagtgtataatgacatgtgtctaccatcagttgtacaaatagttttactgccctaaaaatcccctgtactccacctattcatccctccctcttcactcctcactcaacacctagtagccactggtctttgtactgtttctctatagttttacctttttcagaatgtcatatagttggaatcatacagtatgtagtcctgtcacactggcttttttcacttttatcagtatgcatttaaggtttcttcattcagtatgcatttaatgtgtctttttgggttggtggtttatttctttttattgctgagtaatactccattgtatggatgcaccacagttgatttatcccttcatctattgaaagacatcttgattgcttccacgttttggttattatgaataaagctgctataaacatttgtgtgcaggcttttgtgtggatgtttgtgggaaaataccaaggtgtgcagttgctgcattgcatggtaagactgtgtttggctttgtaagaaactgccaaactgtcttccaaagtagctgtaccattttgcatttcaccagtaaggaatgagaaaaaaagtacattaaaagtaagttctagaaagcacaatattatagagaaaactggatccaaaaattatatacacaatataatctcagttgtctttaatttaaaaagaggcaaataaaagaactaaaaggaagtatgttaaatagtttctttagtttaggattatggttgtgtttattcctaccattctatattttttaattttatttttattaaaccatgagcaagtattgtttttataattataacaatgaaagaaaataggtaataattgctcctttcttcttttggtggcaggaacctgcaaatagtcgtctacctcctcaccttattgcacttgattccacgatacctggattttttgatgacattgggtatctggatctcttgccatgtcgtccttttgacacagtttttattttctatatgaagccaggtcagaaaacgaaccaagaggtaagagttacgaattttttttttttggtatgtttttgtgctataaatacacgtctaaagaaaaaaattgaggcaaaattaatatggagagtttatttgggccagagttgaggactgcagcctgggaagtgctggaaagtgcttccaagaacaaaggagaggctcaagtttttaaagataaaaaggatgagtcaggagagtaggcaattacaaaagttgtttttcaggacttctcattggtttacagaaataacattgattaatgagtggatataaattattgaactgtaggatatgagctatggtgtccagcactgttagattagctaatgaactgttggtggtgacacacagtctagagtccatatagcacgcagcttcaaagtgattacttagctcaagcgggagtgagatgtgactgctatcaaaaaagtgcctttctaggcatgataatttgagggagactcacattccttaaaaagtttcattttcatatacaaaattttacatggtatgcacttgtctatggtaagaagtattttgtacttgatgcctaaagacttgctatgaaccagtttgaaaacagaattaatgaaaactatgatgcttagagtcctgagtcttttgacccttaaggaatgtgatttaaataggagctgtaggatatctttcttccccttaaggaattcagattcacaagacaaaagaaactgaaataacgaaggttagtcataaaagttaaagtaaggctcaagaagaataaaacaatagcaacaaatatttatggaacatcttccctgtggctcagcatcccaggatatagaagtgagtaacagtttcctttttgagaagcagctcaccttcctagtaatttcagaagcaaatcatttcagttgaggaatgcatagtgtgcagtgggagaaataacacctgaaataaaggagaaaaacagaaggactggccgggtgtggtggctcacgcctgtaatcccagcactttgggaggccgaggcggatggatcacccaaggtcaggagttcaagacaagcctggccaacatggtggaaccctgtctctactgaaaatacaaaaattagccagcgtggtggcaggcacctgtagtcccagctgcttgggaggctgaggcaggagaactgcttgaacccgggaagcagaggttgcagtgagccaagattgcaccattgcactccagcctgggcgaagaagtgagactccatctcaaaaacaaaacaaaacagaaggactaagtaaaacatacctggatacgtggaacaaagagactaagagaaggacgaagaaaaatgtaagataggtgagaatggaaaactgagagcaaaatggcaggagacttgaagtgctttttggaaaggaataattgaaatatggaataggcaggaagttactgactgtaactaggaaagagccgaaggaagacttgtaaaatgtcgtattcagatgtgtagggcactgtgactacatgatcctggaattttactgtagtcattttaagacaatcagctaatcaaattagcatgcctaaagaaatttaccaaagtttccaaatgtttacactagaagcactgtttcaaatgatttgtgagctcctagaaaagaacactgatttatgagaaagttttttttttttgttattgagtcaataaagttaagaagtgtctgttgttaggtaccagggttatagtgccgaacaaaatctacaagatttctggccccctaaaactactgcatagaagggaaggcagatgattaaataagcaaacaaccattgtaaagggtgttaatagggtcattaaagcatgttataggagccatagcaggaaaacctaatctggttttaagaaggtggcctggaggaaaagatattctagctggtatttaaggtgtgccttaactgtaggtaaggaggtagaagcagattgtcactgacaaaataataataacgtgtaaattcttcagggtaaagagagcatttcttcatgaatttcattatggggtctaatatgcttggagcttaagagaaggtgggctgggggtagccagagatgagaccgatggagtcaagtgttttagaagaagctcagtaaaattggattaattatggaggtggggatctgttttgcagcaaatcagtgcattgttttgtataagaataatggagccacttttctcctgcctgtacaagaagacacaaacccttgaggcacctcctaacccagttcagtttccttagctttttagaagctgagggtgactaggaattaatgaagatttcctgagatctcctttggaatgtctaagacctgccttccctagccgtagggtagattaagattaatttctgtctgccagcaagtggcatgaaagttgaatttgattcacttactgcttcttgactaaattttcaaaaattgtttatttaaaagttttacttctagataaaaatttgaattgcaaaaactagaaatggttgttaagtcagtttcttggcgtccataagaatgtgaagggatatgggtaaactaaataggttcacttcaaaagagactggttttaggccgggtgtggtggctcatgcctgtaatcccagcacttgggaggccgaggcgcgcggatcacgaggtcaggagatcgagaccatcctggctaacatggtaaaacccgtttttactaaaaatacaaaaaaattagctgggtgtggtggcgggagcctgtagtccagctgctcgggtggctgaggcaggagaatggcgtgaacccgggaggtggagcttgcagtgagcagagattgcgccactgcactccagcctgggcgacagagcaagactccgtctcaaaagaaaagaaaaaatagtctggttttgtgtttaagaggtaatgaccttgagatgatttgcagtgggtcagatgtaatgaatgtaacttcctatattttgactttcacaggcctctgtatgatcttggtatagattagcattgtatgaatgacatcagtgatttgtggactggctgcatcacagtcatttggaggaatttttagaaatagtgattccaggattccgccttcactgattttaatgtagaaggtctagagcaggcgaagagaaccttatttttaggagatttcccagatgattttgatatactctgctctctaccctcccccttttatttttcatttgcaagggaatttcttagtttccttcctttaaaagtgagtttttcaagagcagcactattgccatcttgggccagataagttctttgttacgggggctatcctgtgtattttagaacatttagcagcatctttggcctctaccactagatatttgtagtgtgcctcaccagttatgacaaccaaaaatgtctccaaatgttggatgtctgctgaagagcaaaatcacccctagatgagaagcactgttttagaatgaaggactctttgtgaggccagtagaaaccccacgcattacatttagtgcttagtgaagaggagagaactttctggacacttcatttttcctggaattctcttctttggcctaagaaaaggatattttcatactcatttattaattacacctaatgtttattgaattttagtagattttatagcatttatcaagatttatagttaaataattgcatacctatgtaatgtttctcattaaccagacagtaaactctgtgaaggcagggacatagtgtcttttagtaaacatgcctggttcagtaattgttttgccaggaagagagctcagggcttttcttgcattacttcacaaccattattattatctctactttatggattaagaaactgaggcagtggggttaagaaacttgcccaaggctcagccaatccaaatctgtctaactctggagaatgcatttttctctatagtgatatatcctcaaatttattctgagcttggacatgatttgtcagaagcttcaaaactaaccaatttttatgaagatttattttgatatattattttgtttccttcattatagctgatgattggtatgtatttcagattttaaagaatgtggagtcttccagaactgttcagccacatttcctagaatttttgctttcccttggctggtcagtagatgtgggcagacaccctggttggactgggcatgtttctaccagttggtctattaattgttgtgatgatggtgaaggatctcaacaaggtaaaactcacagtgtttcaaatgtcagttgtttcttgtttgttagtcttgtttttttttttccccctttactgtgatttatagtcttgttaaaaatacaaaaccaggctgggtacagtggcgcatgcctgtcttcaagaagccaaggtgggaggatcgactgaggctaggagttcaagaccagcctggaaaacatagcgagacaccatctctacaaaaaatgaaaacatttctaggcttgagggccatgtatttgtagtcctacctgctcaggaggctgaggtgggaggatcacttgaggccagggattggagctatgatcatgccacagcattccagcctgggtgacagagcaactccctgtctctaaaaactaaacagaggtatatagaggaaaagtatccttcccctaatcccagtcctgacagggtaacttagtaacagtttatatattctagacattttcagtgtatatgaaagatatgtatacacataatgatagagttaatacaaaatgactggcttattacaatgctgataagttccttttttataatatgcataagattcaattttctatacaaatggtgtaatataggtcatccatacaaacaatacagcttcctaacaagcatgttttgtctaataagtagttttctattaaccagtgtgttttaccaactgtggctatcaaaacagtcacacttaaaggttatattcttgggatattataccaaaacctttgtagtaaacagctgaccatctctgaggattcttgcccatccccgcagatcctctgaggaactgtaatcaggataacaagtagcagagcaagtataaacttaaacttaagacctttgccccacctggctaatgctttctgttcctgggctcctgaggtcactggaaagttagtgttacctctctaaagtggataatgcctatgcccagtgcacatttttccttttgataaatatatcagttggatacttatggttgcaagtatcagaaaacgtgacccaaactgccttagattttaaagataatttattgcccatgtaactaaaaattccagaggttggttaagtttttggtgtcatttgattagcattcctgttttatttctttacaattttcctttagctttgctctccatattttggctttgtccccagcctggcttctctaatagtgcagaaaggcaattccaggctttacattcacataccacagcagcctgaagaggagagattagccagatctcagaactccctactccccgaatccggaactatatggcgattagactatcccaagcctgtccttatggcaagaaagatagaatgactctggtagagagatacaggcaagctagaactagtatcagaggtcagtcccacctgcacattttgcctgctgcagaataggggtggatagagtggctattgggatagtaaccacagcatctactacatcaaatacaaagtgcctgcccggagcccacaccaggagtcagaaaactaaagccctgtttttgtaaataaagttttattggaactcggtcacactctagattatacattgtctatgacagctttcatgctacaatgacagaatcgagtagttgtggcaaagaccctgtggcttacaaagcctaaaatgttatctgtctggtcctttacagaaaaagtttgctaacctcttgtctaaagcttcctatttgccataccttcaccagaattaggtatcttccaattttttcggtgagaaatttttaatttttaataatggttgagcatatcttatcatatttttatttattccctgagaagtacttgtccatttcccctttccaatttttggtccgattgttggtcttttatgtattgctagtaggacactgagttcattttaattgagaactatatagctctcatgaatgtttcttttgttaattcagtcttcctggcttagagcagatactattactaaaactggctgtacatttttatacagtgtcactgaccattgaggaaggtggaacataggccaacttgaggagccatagagagagaccagggatagaaatgccttaaaagcaagagtccagagataacgcacatgtgcactctctctcttctctctcttcttctctctctctgtctcttcctccctcctcctcctcttcctcctcctcttttcctcctcctcctcccttcttcttcttcttcttcttcctcttcccccctctctctctctctctgtctctctctctctctctctgcctgcctgcctgcctgcctgtctctctggcccaactcccttctgagggactgggatggtcttccttttgattatttatttactggatccaaaggactgctcccttaatctgcttcatacacttgaattaaaagccctgctaatcagaagtggtctgatatacagtcgtttcagaaattatgaaattaagattttattatttaaaaataaagacatctaataagcattatattttattctttcatactaattggttcttgttgaaaacatatattctatttatcactttattaaccagttaacatttcatgtagcaagatgatactggttttttcctactttttgaagcggtaatgtagtgtttctttttcccagaagaagtgatttcctctgaagatattggagctagcattttcaatggacagaagaaggtgctgtattatgctgatgcccttacagaaattgcttttgtggttccttctcctgtggagtccttaagtaagatgatttttgcatggtcctgttttaggatctatttttatattcctgggttgtgtgatattactgcattggaagagattttgaagtgatctaaggcattctttagcttctaaggcattataacaatatgcagaagcacaagatgtcttctcttaacttttttatggaaagtagttaaagacaagcagactgaccctctaataatctttaaatagtgaaggaatcccatttcaactgatattttgctttctttaatctaattaatcaatacataggcttattttccagttcatttctttctctaattacgagtgatccctcacctacttttctattcccatatgagagcctttgcatggaaccacctagaatcctacaactggaagtatctcatgatagcatatggccattcttctaacactgagcaagagaaacttcagcagcctagaaaagatggtggtccaagactttttaagaattgggagtaattattacttcttagtctgaactcacagttttattttgcccagaacctttgctctttgcaaattaagcctgtttgttcatgcctgaccgagtaggtggtctggcagtaggtgggaaacttcaccttcttctttgagatcatttgtaggatgggatactatacatcacgatttcagtcttatttccagactaatgacttttgttgtgccctaccttggtagctgcctaacctttgtacttggacccttgatttctcactctaggcccctccctgtcttactctctggggccggctgtgttcctggaaggttggaccttccatggtttaggtttgaattataacagctgttgggcttcccgtcaaggttctggtttactacttataattccagaagccagaacctgtccgtcctctttggggacatacctgcctggtttctctggcccagcctgttagtaccagacaagtcctcccagagctagagcctcgtccttattctatagctcctgcaattgggtctttgtctcctgttgtgaaacatctcctatgccaactgtgcccactccaactcagcttcctcctatttctgatatttggggatttttttggatggggtggaggataactttctgtgtacttatctccaaccagattgctcttaatcacagagactagatcttctgtagcttctggatgtcccagtgcctatttggcacaatgctacatgattgaatatataatctaaataattcagagagtaataatggcatttattatattctacatctgaaacgtcaaatattttctagtcttattttggttatcctttagagcaggagctggcaaaccacagtggcacaagccaaatgccgccaagaatgggttttacattcttaaagggttataaataaaatataaagaagaatatgcgagagatctgtatagccagcaaagcctaaaatacttagtacttgatcctttacagaaaaaagtttgtcagcccttgctctcgaagcaatgctttgtttaagtgatttaggttagactggtgagcataattagttttaacagccttgctccaaataagtggtatgtattatagttgctttttttcctttaccccatagctgattcattggaaagtaacatctcggaccaagatagtgattcaaatatggatcttatgccaggaattctgaaacagccatccctgacacttgagcttttccccaatcatacagacaatcttaattcctcacagagggtaagttactttgttgataggtctccaaaattttgtagtgaaatcagggtaattatagaatcctgcctgaaaagcttttaacccagagagtatttatatcagagtactgattccttagtaacttaattttttaaaataaaattctcacgattttctctttttcagcctgtaacaaatagttcattctgagacagcctttgtggtttctcttgatttcaccattctggtcccgtacttgattctctcatctgttcctttttaagcctaggttttaattttgtccctgaaatatccactaaagttactgcagtaactacatgtttttttatctttaatcttgcaatgttcatcttaaacaagtctgaccatataaaaataggaacattagggagaataactcagtatatggataaatattctgagtgaggaacacagcacctactacaagaggagctttttgctttatcttttttcttaccttatcagcaaatgttactttatctgtgatcaggtcagaagtgtaggaagattgacttagaacaaaacataacaaagacagaagtgtcagcttgactaaaggtgttcctccattgtacaggattttaggttagcttccttccacagtgaaagttatttttaatgtaagtgtatgcttaaaagagaatacggggaggtttttacctttaaaattgatttaggaaaaaaatgccaggtggtgtaatagtccctggagtagattgatttgagaatcaggagtttttaaaaggttttacagaatacagtttagagatgatcagtcagtattgcatagcaatgcaagattttagccaaatctaatacttactttaaaagttttttttatttgagatttgtggacagaactagtattcagtgattagctgcccttatactcattttctgaatgccagcatagttattccttagaacccagataaagcaccatgtttttgtttctcacttatactgtactttgcagacactaacagactaaaaacaaaaaaacaaaaacaaaaaaaaaacaaagcaaaaccatatggttatctcaatagatggagaaaacgcagttgacaaaaattcagtactcatttatgagaaaagttctcagcaaactatgaatagaactttctcaacttgatacagagcatctactaaaaacctacagctaacattatacttatacattgtacattattcttgaatgcttttcctctgaggtggagaacaaggcaaggatgcctgttctcaccacttacgttcaacatggtagaggaggggcctacacagagaaataagacaaaaggaaacatagtacataaagattagaaacaaagaagtaaaactgtatgtatttgcagatgacatgatcatgtaagtagaaaaccctcaggaatctttttaaaaatccactagaactattgaggtgagtttagcaagattgcaggaaaaacgccagggtgttgggcaaaattttaaggtaacccccagcgacgtttgcctgtgtacagtgtcctctccttgcgtgtgggtggaacttgtgactatgataggataactgtgattatgttacattatttggcaaagggatcctgtgggtttaattgggttactttgagttaatcaaaagggagattttccaagtagacctgacctaatcacaggagctctttaaatctagggctagaggtcagagatggaagaagttagagagagagtcaaagctaaatagggaccttgatactaagaaagtagtctgtgaatatggccagatgtttgtcactagtttgggagaaatctcttggtctggacattttctgtgaatgtcagagtagatataattatccggggggacttgccatggactctggtcatctggtaaagacatgtatatttctgtgctaataaagtagttttaattttaaaattcacctcaagtatgagattcttccctctgtacacatgagctttgtttagggctttagcacaaacttagctctgctgcatgcctcaaaagaggtgcagctcagggtaccagtttgctaaaggggagccacatagtcctgttaaccttgcagtgaaacttaagagttgattagggtggcaggaagccagaagcacactgcatggtaatgaagccccaaacaactcgtttttctttctactgatgagaaaaaggaattaagcataaattgcagtaggagacatttggtctggaatctaggaataacttgctgatgggacattttagagattaggatccccagacaagtagtgatgttgctgtgatggggaaggatactgctttctggccctaacagagatagactcaaatcttttaagccctcattaagatactgtgtgtaaattttgtttttattaatgcaaattataattattcagtattccttcctttttttttctttgacaattttaagccttgtcctaggttaagactgatgaacaggagccaaagaagagctttgttgcaaatgtatacactttttcctaaagtgattttccatgacctgatacttggtcactgagcaccttgacaaatgaatgactgggtagttttattaagccagttttttgttgctgttgtttttcccgctctctgtcttcttcttcttcatgtagctcagtcccagttccagaatgaggaagctgcctcagggtcgccctgttcctccccttggacctgagacaagagtttctgtagtctgggtggaacgctatgatgatataggtactgtatgaggactttgtccataaataaaatggcaatatatgacagtgacttgctaaatgtctacagggagtgggcacataagcctggtgtggccaggagctagtcctggagttcagcaagccttggtttgtaccccagctccactactcagtttctttaagccttagattactcctctgttaaatcctggtacttttttcatagttgtgaagattcgatgagaccagtagatacaaagcttttggctattcatgttggcatcacagtcagtggtttgttgccagttggtctcagtcatcccaggacctttggaaaggggaaggggaagcacttcacttaccctctctccacccacatgtcctactgtctcgttttagtataaagcttaatttgtccttaagagttgcactctgggtaagtttctcatgatttttacataagcaacattagagcattagaaatatatacttgcctaaaatcccatccagcccagagtttgtgggaaagtgtgatagttacttttcaaccaagccctcaaagatcacagaacatattttctaaaaactctttgctttagatgaaattagctaaaaaatgtcttgagagagaattttttaatttgtagagaataattaagatgatatttcaggacagcacagtccatatatttgccactcacttatgtaaagcgattagaaaattagatttcctattatctgtttgggaaaatgagggagatattaattgtaatgctattattttcttccagaaaactttcccctctcagagctgatgacagagatcagtactggtgtggaaactactgcaaatagtagcacttcactgaggtacactctatttgcttgaagttcatcagcgtgtctttttttaacatattgattgcagcttaataaataaggaattatgaaacgaaagagttgtagacaactagaaataaaaacaaaaaagatcaaagaaagaagtttgtatacaatgtacaaggttatcaaattattatagcatggatttttttaaaaccactttattgaagtataactgattgacttgttaaaagctatacgtatttaatgtatacaacttgatgagcttggagataagtatatatgcatgaaaccatcacagcaatctattcctgaacacttctaccatctccagaagttttctcctgcccacttaattcattattattattattttgtaataagaaccacttaacataagatctaccctcttagcaaatttttaagtatacaatactgtattattagctgtagccactgtactatactgttgatctttaggacttatcctgcataactgaaactttataccaccttttggctaatacctccacatttttccctccctgcagttcctgacaactagaattccactctctgcttctctgagtttattttagatttgtcatataagtaatatcatgtggaatttgtctttttgtgcctgccttagcgtaatgtactctagattcacccatgttgttgcagatggcaggatttccattttaagactgaataatatttcattgtatgtgtacaccacattttccttgtctattcgtccattgatggatatttaggttgcctccatatcttagctattgtgaagaatgctgcagtgaaaatgggagtgctgctatctctttgagatcctggtttcagttcctctggatatacaccctgaagtgggattgctggatcatatgaacattctatttttaatttgttgaggaaccatactgttttccacagtggctgtaccagtttacatttccaccaacagcatacaaggggattcccttttctccacattctcgccaacacttgttttcttttggtttttttgaaaataaccatcctacctggaatgaggtgctatctcattatgattttgatttgcatttccctgatgactggtgatgttgggtgctttagcaggagttttaatagtataattaattgctattttacatttatctagagcaaaaagaaaaatggagaagtagaggcaattaaatattaataaagaccgtaatagtagggcagcaatattagattgaaataatggagttaaattggccaaaacagtgtggccaaatagcagttaaaatatcctaaatcatatgagctaattaacggaaatatgtttctaagcaaaatgtaatactttataattgggttaaaatttgttttacctgcccatacacaagaaggataaaaagagaataatctgattctaagaatggtaacaatgtatttgtataggctttgtagttttcaaggtttgcttacttgtttttggtttataactctaagagttcaacagttattttctgttttactagtgggataaaataggctcaaagaggttattccttagtatcacacatccagtaaatgcaggagaaagctacctgaatctaggcctttgaccccaaatgcattgaccctgcatctctctcatcacagagctaccctgaaacttgatattttaagttccttttagttatgtgagctgattcaaattgcatataagatgaatttattctaatattgttaggtgattgttgttgaagtcagtaaagatgatttattttagcattatcattttaaacttctaaaagagggcaagtcattcttaaaacttccaggttttatatgctttggtgttttaaaacaaatcacagatatcttaacgttccaaatacatcagtatgcatctgaaaagtaagaaacttttcagatagctaaacaacatcgcaataataaagttagtaatactttcttaatattatctaatagccaacattcaaatttcttcatttttactaaaatattcttcacaattggtaaagaattcactccaggactatatatctggttttaattccttcagtctcttttaatctggaacagtccttttttctttatgacactaacttgctaaagaagagactatagaatagtcatgagtagacttttctggaactaattagaagagacttacttatcatttactgtctttgttgttttcatctttttttttttttaatttaaaaaaacaaaacaaaactgggcacaaggtatcaccatgttacccaggctggtctcgaactcctgggctcaagtgatcctcctgcctcggcctctcaagttttcatctttttaggtcaaaggttgtaatacaatttgacagtaaaatgtatattttattggtagattagcaaagtttataatttgtcttggggacagaattactcaaggattgatttttctttttttttttaatgtcttgaaagattgattcagtgttgctttggccaaaatcaccttacctatatagaaagaaaattcattgggttgcaaaaagaccccaacatgtagcatcacaaataacatgtaatattagatgggttggcctatccctggtgtgtaatgagtaactcgcccctccataggagcagttgccaactttagcatctgctgccttgccagaggctgtgagggctttggccctgccacagtgcggccatttatcaccatagccgagaaggacatttgcagctggcttagattaatggctctcccaacgtccttccccaccctgaaaaaaaattatatcggggattcctgtcatgggccgaagctgtgttcctgcttctcctctgggattatcagccttgactatgctgaaattccttgtactctggccggccacacttttgttccctataagaagaggaactaaagtgaaagtcccatagctggttgctaaattcttaactccatgcagcagagtactcttggcctctccttccacccagtgtccctattggttttccaagcatatatattttttcagctcctttctgttagcttagaaagcttgacccagtaatggacctttaggaccagatgttatagggggtagcagcatagattcccagaaagcagattctgagcacactgaccccttggcttttctcagaccactgccaagcaacaggtccctttactaatcttaggctatatgtgggggacttcaactcttgggtgtctcggggacttcaactcttgggtgtctgagataacaattttcttttcttaagatctacaactcttgaaaaagaagttcctgtcatcttcatccaccctttaaacactggattattccggataaaaattcaaggagccactggaaaatttaatatggtcatccctcttgtggatgggatgattgtcagcaggcgagctcttggtaaggtcttcatatgtggccgaagagttaaattttctttttctttatcatttttataaaccaaaaagaagtaaaaataaggaaatggtgataattaatagcttccacatgtaggaaatggtatggctcttgttaaaaagggagcatgtttcgttctttttaaatctgtccttaatctagtaagtgtaagtaaaacctcactaacttctagtattaaaatattgaagatagctgtttgtaatccaggacagaaaataggtttttagaatagattttgattctccttttccttgtcattgtgtgtttcttctgacagttttatcttagcactatgtctatctctctggggatgggaagtttgcaaattgaatgaaatagttttgagtatgcggagaatagttcacctgaatacttacagttcacctacgtaagtgactagtttctaacgtttattttaaaactctctattttcaaggctttctggtgaggcagactgtaattaacatttgtagaagaaagagactggaaagtgactcctacagtcccccccatgtccgccggaaacagaaaatcaccgacattgtcaacaagtaccggaacaagcagctggagccagagttttatacttcacttttccaggaggttggactcaagaactgcagttcttagaccactgaatttctaagactgttgaactccagtttgggaactataacacagcagaacagtttgataggtgatcactgtaaaaataaaaacaaatcactcccaagagcttactgtttaatcaccagaatagaagaaacacattataacccatttgatagaagactttgggctatctagtgaaatgggctcccagacacaatcacactcctgctgataatgatgatatacattttagccataaactttcttttaaaagtgacaattttagttaaacataagccttttgaggagaaaggcttttatgcatctcagttaaacacgtgcattggtagtatcaacaaatttgcaatatagaagttgaagatagttttttacctcactttttaggaggttgtattcaaaattaaaatctcagaatcttacaggacatttaaagactcatgttgatagcatggaggagaaggaaagaagtcacagccttctactcagttgtaggtcttcttgtcatccagctgtcacactgacaaaaagaaaagatgatacatgttttttgctcagataagaagcctgacattaaaagatgtcatatttttttctccacatttcaaaaagttgtccttctcatcactgcacagatctgtctgaaagcctcagtttctgagtgacccaggaacagatcagaaatggagcatggccttgtcctttaatggggatgcaaataaagtttgtggggttaaaagttataagacagcagtgataccccactctctccattattgtccagcggggtgacataatgacaggttaaatatttgtgattcattgattaaatattatttaaagaaatgtaaattcacaataagggttgaaaattatttggtttcatccattgtctcttatttcaggaccaagcagcaaactgcagtagtttgtgaaggattctaatatggggttcaggaatagcctctcaacgctactaattcagatctctcccagagaactactggatttcctcataattgacaaacatgagtgaccacctctttgggtggctactgttagaaatggctgttgtcatgttttctggactttgccagccaacagatccctgccaggttttggaaatacttctattacctcgctgctacttttctgcagggataaaacttttgaggtggccagacccagaacatccaaggattcctgttacagtgctacagtatacactgctcatttatcctattctcatgtgctttcttctttagtaagattattttaagaaaataagtgatatttaaagtccaaagaggaatgatcacagttgtataaggggtgttttcccacttgaactctgatgtcagtcgactgtgggtcagagctacaaccatctgtttggtttgatgttttggtggtttacttacggagtggggatagtgtgagacctaattccctgtgcaaatgtctcttattccagaaatgtgcattttgtcatctataagcaagaaatatgggcatagcagctcttggtttaaagtttgccataacctgttcatgtttgttttaagctcaggtaaagataacctcctctttctatgactccagtttccattcaggttatagtattattcaatagttgattttctttttaagctgggcaataaattgatgtttccagatggtaacatgggagagggcatataggataaagatgagcaaattctaccctaaaaatgttctagtagttcacaggaagaagatgaggtttaataactttcaaggtaattctagattgacattttgaggggaaaatgggctcttgttctagttgaagtgagcagagaaggctataaattaatatgtaacttacagcattccagaggttaaaaataactgatgcagatgtacttcttcagtgtgattcttcagatcaaacttttacttttggcatagttaatttcagaaaaatgtgctgtatgtgtgtgtgtatgagggttggtcttgctgatccttcagttagctctaaattctggcaactccttgtaattccaatgtatttgatacatgaacaatcatgttgaatgcatttgtgatctgggagacttcctcgtcttccagggaaggaaggatgtgcagcccctgaaggcatgaaactcccagtgtgtacggagccagtggaatatgggatacccataccttaccaggcgctggttccttctgctcacaataacatctgcccaaagagggagtgggaagaacgcttagctctttcactagtatggatttgagttcatggtcactatttttacccacctgcctttgttaaaaatcactttgagtagaatagcactggaggaacatatttagcacctaatattaatatttagtagtccattgataaatttgccagcatatgttctagcctctggggggaaaccaggaccacttttgtctgtggcttaaacagttcagttgctatatctgttgggtatgccgggggtggatgagtgtggcattccgtgaagaggaaggtggtaagtaaggtttcccttctactgccttcttaagttgcaggagggagcttttctcctcccctctggttgggagcactgaggacagtgaggagggcttttaccttgttaatcctttccttatttagctagctttcctttttgtctagggcttcctcttgagaccctcttccatccattgggcctttgaaaggactaatcagacacacacacacacacacacacacacacacacactcgcatactcatgcacattttccttcatttccagatcctttatttcagagcagcccattttcctctggattcattgatgaatacaagtacccacacctttggccagtaatgtcagttacctgctgcaggttctgtgtatgaggccttcatgaacggttaccttctccatacactagggaagcatttgtcagactctgcagactgggttctagagaggcagagtctttaagagtattcatttcttctggaaggtggagctttacccaaagtggaagttagccttgctcaaagatgtgttttgtggtaggtggtaaaaataaataaataaataaataataaaaaaagaaacatgtattggaggtaatttgacactgctgctggcagtagttctctattcaccattttaaagcccattcaggttctctcttcctgaaaagaactgattgctgtgtttacatgaaatgacattggagtcagatggtctgttttaaagatttccatgacagcctcttttcctgagttggagagattggaggtggtctatccgtacgatgtggaatcaaacggtgggtttcttagtagctaaagaagccatgtacttctagtgtgtttctcagaatatcaactcatgttcttcagatgcttttctttttttaatggtgagggaaaaggtataatttgggattccacagtgccttgcatatagtaggcgcccagtaaatacttgttgaagcaaaccaagtttcccaagtcctcatctcttatagtgaccaagacatctttctcctctgaagggcttggcagttgtggctaaaaaataagcagtatcattatttgcttgaaatcatatatacagtttgtatgaatttcagtatgttgccaagacatgattttttcttattgtattttctgtaaatatttctggcactgaactgtaaagtaaaggcaaagtgtaaatatgaaggcgtgcccgtgccccttgcctcctgtgtttcatcttcgtcggttagggaagaaggtccagaggtttgtttgtatttatgccgatcctttgtccagaagaagcccatggaatattgaatgtaatacatttagtcaattaaattttaaggagattcttatctaataactttgtgtgtgcttttggatacaggctgaggctttactcctacactggtgctgttaattttaccctttcaggggatgtctgctcggctttggctgccctttataatttagatctgtagtttaaatgaacattaaatgagtatttcatgaaatactcaaagtttgattaattttaagaaaagtatttggccttctctgctggaaggagcttgtataattaaaacactgccaatagaggctcacctttcaggggctgcgaattgctgaggagatagatgcttatgttacgggagcaagaaagtgccagctgtgccctctgcttgcagaaaatttgagccctagtaggactagacagtcaggaaaggggggaggtgcagagatcatcccctgccgcccactgccccctttgtgaagggcatcttggagccagatgagtgccttcaggcctggatcacacatagtggagtgaatggaccacttgaaacaatcatgagaaccattgtggccatgcctctgccaagagctgctgacgtgtgccctctgaactgtgcctgggagctgcctaccttgcactgtgtgttctgcctgctctgcccacgcacaacaggacctccagctgggcctagtggccagagacgctgactgcacagtagccctgttttggtgtctggaaaggttttgtagccagaaaaaaaatgtgtgctcaagcctttcccagctatgctgctcagctctctctctgaccgcagccccttcaggacccagttccagggaatcacccccaacccagaccacctgctcctccttctcttggcctctgggccctgcatcaggagcaccctgccagagcactgctcctcttggacactcattctagtccattttcccagacttcctcttgtaggaattctggccttcccacagctgggctaggactcttgaaaccatgccccagctctcccagcccctcccatgctcttattttttcctgttgctggccccatgcgcccttctccttgaatcggtgtcttttcctataagggggttttctactccatgtttttccctaagtttaccacccccttcctgcagctgctcccccgcctggacctggtttgccttttcaacaggtgcttttaagtcatgagatgctgtagtctcaaaatcaagcctgcatcagaatcattctagttgcttatcagtgtgttgaatcccaagccacacccccacccccaagaggtctgaggagacgaaggtgagcctgggaattggcatgtttaataaatacactccagcacccacccacctgctggcagtcacaggcaggtggtccaagggtcctcttggagaataccatgcagcagccactccagtgggaagcccgaagcctcctttctgccatggtctggcacatggaggtttactgaatacttgatgagtgaacggatgacagataggagaagatgaggatgacatgtggaagtgttctggccactcaggagataaaggaacaagattcaagtcgttagaagcccctcactgaaaaccctaataaggagaggcacaagctttcagattaagtaataatcatttatagtcatttaatctagtaataattagaataatctactatgtgttagattttaaaagttttcagtggcagcccagtgaccaatccagcctggcagacgttttgtttagccaacagtgctttgacaaggtctgatccgacattttaaacttgggagatttcacagaaatccagactttttgcctgtcttgggaaagttaggagtcctgcaataatggacctgcatttcacttgtagcagttattggttggagctgccatcactgcatgcttaggatgcagtaagctgcatccagtttgccgcagtccccagcacccccaccaagtgtggacgtgggcacccacagctggtattacaggacctggggacccagctggctcctggagggggtctgtgacttcagatatatgaacaccgatcctgggggtaatttttgtcccatctatttttctaacttaacagaattatctccatcttacaagaaaaagggtcagaggggtgtcatgaacccaatagctactggactgagattcaagcccaggcctgcctggaaacctgggctttttaattctcagccagactgtctgtctcactgcctcacttcccaccctttcatccagaacagctctccctcaaagtgtcccctgcatgctttgcctgaagtacactgtgacttctttgttatgtcacagcttagtcacagttgggctgagagcagagcatggcccagcctgccaggtcccatggggcagccctgccagcccagcccaggctggcccagcttagccacacatgcgccatgaagtaccctttgatgccgctggtgaacgacctcacattttctttcctggttttctggttctgcctccctgtgggtttgctgttgttattgatcatctggctacgcttcttacttagccaaggtgagcttcttaccccgtccaggcaggaccctaatcctggagctaggcagggggccaaataggccagtgtgtcctgaaacaactgcagaaggggcttccttcagtcattttaagtgctcgcttagatacaagcagtcaactcttaagtggaaaggattggtttggttgtttagggtttcttaacctagagttcgagagtgagtcctagagtttgaacctagagttcgagagtgagtcctagagtttgaacctagagtttgagagtgagtcctagagtttgaacctagagttcgagagtgatcttttgaacaaatcagaggttatcgctccaggcagatgaacttccaggtgcccctttcagctggggtgcaaggctctgtgagcagagcgtgggctggatttcagccccgctcaccctctcaattggctgcttttgtgcagtaaacagcttgcacgatgggatacagcagccttaggcatttttcagatacctgcagaccactcactgtttctgcctaagccatgtatcagaaaggatctggctgctttgggagacaggctcatggaagccagctgacattcaccctgacctcagcatgccaccaagaggagcaagaggtgggacgaagctggctgtggaggaagctgggggtggctggatcaggatatggcctggctgtgtggcaggagtgggacttctgctcctctggcatgtgtctccctgagcatccccttcagcaagaggtctcttcctgctggacacagtggctcacacctgtaatcccagcactttgggaagccaaggtggccaggttgcttgagcccaggagtttgagaccaggctgggcaacgtccctacaaggaatacaaaaattagccaggtgtggtggcatgcatctgtggtcccagctactgaggaggctgaggtgggagaattgcttgagcctgggaggtcgaggctgcagtgagccgagatcacaccactgtattccagcagacagagtgagaccctgtgtcaaaaaaaggcctcttcgtggggaccacttgacctcctacctcctgctgctgagtgccatgacctttggcaagctaggcagggagggcgcagcacatgccgccagcaatggtcagatgttgttgaggcagggtgagaagtccctccccacacccctgctagccccatgatctcaaatgtaggggcttataattatgtaattattgggagttcctggcaagaacttgggatgtccttttgtttctagaaagtgtttatttaaagtatattctcctcatagtcctagggtagaccacagccctccctgaggggcacggtttaggcattgggccccacagctggtagggagtcagccttgtttgcatactggcgataaaagttgtctctctggagtctggaagatatgagttcagatatcatccttttttttttatttttattttttgaaacagagtcttactcttgtcagccaggctggagtgcagtggcacaatctcggctcactgcaacctctgcctcctggcttcaagcgattctcctgcctcagcctcccaagtagcggggattacaggtgcccgccatcacacctgtctaatttttgtatttttagtagagatggggtttcaccatgttagccaggctggtctcgaactcctgagctcaggtgatccacccgcctcagcctctcaaagtgatgggattacaggcatgagccaccgcacccagcctcatccttgcttcttaatagttcctaataatagtgaacctgtttggaacactgactatataccagaccttgtgctaaacactggacttgcataatcttatgtaatcctcataataaccctgcttaataatacttaataatatcacaattggggaaactgaggctaggagaggagaagcaacctgtccaaggtcatacatctgtgaactacttaagagagccaattgtctgccttcaaatcctgactctgccacctaccagctgcatgactgtggacacctctctgagccttgcttttctcatctacaaaatggagacaacactagtacctgccccttggggttgtgacaggcttcagtggtcgatgcatatcgggtacttacagggcagggcacacagtacgcatacacacctggcacatcgtaggttcctgtaggctgagaaaatagtccagccaatgctggttttgtcaatgtgggaggaaatgcaggtggtgtggctttggatgccttctccagagaggagacatttctcctaccacccaggccaaggcctgcagcatgagtctcctccagcattcactctgcttggaggcccaactccaaaaccatccacaacctaccccactccaacccctccgcagactttctcctgagaggctgtttactggtgtcatgtggcgttttgaaataagtcatttgttaattttgcaacgaagagaaaccgtccttaaagtgaggtgggcattcctccctcaggttctccgtcttctaaaactcccagtattattgtgcgtgttttgcccttgtgctgggaactgacccaatgtcagggtttggggggctaaggggtcaggacacccagacctgcagttttctattctgctgcagatccctttattggaatcagtttgcctgaaatccagtttgaaaagcagacaggagtagctctgccgcctcctccccaccaccccccaacactcctgctggctcctcagggcagtttcaggcctcagaatacagagggttaagcgtggaatacccgacaggatgcactttcccaagtcgaaggaggagcaaatggggaggaaaggagagctgcctgatgaaactggcactgaggcaaaaatgataatgggcagctcaactcctgcagaagctggtcagtggggacagtgctactgtctggccatgacatggccataaggtggaggaagccacacacacccttcaaggggaagatgccctgctgccggcattttccttttgcgatttgaaaggagtttgcagaaggatgaagggaaacctccaaagagatgggtttggggctgaaacagaagagtggcgcaacaacccctcatggtgggtcttggagcaagatgttcaattcaaagctgcctttaaatcctctgagtccaaacacacccaatggaaccgtggagtggggaggctgaatttgcatccagtagcaccactccctggctgtgagcctggacaagtgatttcaccatcctcatctgtaaagtacaaaaaatactagtaattgacttcaggaaggtgttaagaggatcagatgagaaaatgaatgtaacaacactttgcacatactctatgttcaaaaaatactctctctagtgaagaacagtcacttcacgctatcctactgactttttttttttttgagacggagtctcgctctgtcaccaggttggagtgcagtggcgcgatctcggctcactgcaacctccgactccctggttcaagcgattctcctgcctcaacctcctgagcagctgggactacaggtgcgcaccaccacgcccagctaatttttgtacttttagtagagacggggtttcgccatgttggccaggatggtctcgatctcttgatctcatggtcacccgccttggcctcccaaagtgctgggattacaggcgtgagccactgtgcccggcccctactgacttttaagacatactaactgccaacactgttgaaggcctgtgctaagtcctgtgctgagttttacatgtctgccttcggttaaccctcatcctagaagatgctgatattatgcccattgtacaaaaacctttgttacttctctgcaactagtgaaacaatgcaagagtttagtaagaaaaataatcttccccatccctctttttttctcaccctacctccccaagatgagtctgttagcaaactcattaacgtgtgcaggttttcaaaacaaattggggaatggtgcagcatttgcttttcaaaacaaaaagatcctacatttctttttaatttgcttataatataccgtagatattctgcaagtcagaagatacagatatgatgcaaacattttaacagcttcatgacaagccatcagacggagggtccgggtctccatgtggtgtgactctcccacagcttagtcacccagatctctcgtgatctgtggacgtggacacagtttccaggtgttttattgttcgtgtgtgcgtgtttcatcacaaaacagggctacagtggagatcattgtgcctttgtactcagatgtttgttaatgaatgaactagtggactagtggcctggatgggtcaataactgtgtctcttcactgcctcttcctggaccatgtccagtacagtatgtcatttgctcacctctgtgtcctcccctctagatacggccattttccaagtcacaggagcagccttctttcttggtccctggtcaccctttaaggccctgaagtcttcctgaggcctcaaggctggctcataggattctgccttggccctagcctcaggcaaggctgcagggatacccaggcctggcaggggactccttcctgggtcaggggtaggagacaggatgtgaccatccaagaggccttgcctcgtatctccacagattcagaggaaaatgactccagtgtgtgcttggattgggagccctggagcaaaggcccagctgagttttgctggaaggggacactccacggccaagagaaggagaggccctgctggtgagcctgctgtgccaggtgaggcccttccaggggccagggggagcctcaaggcccacccaaagccttgggcagctgctatgtgggcaagaggctgcctccaccatattagaggtatgctccctggccatgctggatgacgggttctctccagcatgtgagagccttctgcttcattgtgggggagacctggtgttgccctgttaaagggccagccccctgtgccacaaggagcctttacaaaggtcccctaccctttaccctagggcctcaccccccaccactttcctgatggtctttggccagctgttccctcagacgtctgcgtggggcactccctcccctctgagggcttgctctaatgtcactttttcagcagagtcccactggccaccctattcgatattgaagcccccaccctatcctccgcatcgtgctgcttaccctgctctgctttcctttcactgtagtacttaccgccttctaacacgtttgatcgtggctgcatccaaagccccaaaatactgccagacacatgctagaggctcaatacatgtttgtggaaggatgacatgatattattattattattattacaatggctggtatccttgggggctcaataggtaccaaggcctgtctgaaccgttccccttccacaagcttacttatgaaatcctatgatgaggatatgattctcacctccatttacaaatgaggcacacacacatactctcatgtgaggtgtcagggcaatcagatgctgtacccaaaggcccttgcacccattgaattcctaggagacctcagccattccagtggggttagatgccatctctataccaatggccccaaaatgtgtgtgtctcatctaatctcctcccaagctttattatctgtctgcttgacaccctctcatgcctagaataggaatcttgattcccattgtcacccagccaagcaaaacagcaccctgatcttctgctagcttttcttcatctccatgaatagcaccactgtggattgattctgttgcccgagtcacgaacccgggagccagcctctcgcctctctctcccaactctaatctccatctctcacgtgtccgcctttctctgccctactctgaagttggttcatgcagtgtgttcactagcccccgaccctgtctgagtggagggaggaggtggtgaaaaggagggcccctcacttaacctaagttgtaatgattttttagccttttgggtcccaccttgaccactgagggcccttttcccaggaaaactcctcctatgaatgccctcagagatttgtgtacggggccagctccacaggtgtgtaacctgcagtcccacaaggtcccaggcttggtttcatgcttggctattgctgtcttgaaattcttaatttttgaacaaggggccccacgtgttaatttgctattgggccctgcgaattatgtagcttgatctgtttttatataatttgtggcatgagaaaagattttcggacgctgcacaagaaccctatcccatttatgcatagcccttcccttcccacccccatcacttacccacctctttctttcttttttccctttttttttttttttgagacggagtctttctctgttccccaggctggagtgcagtagcgcaatctcagtttactgcaacttcttcctccccagttcaagcaattctcctgtcttatcctcccgagtagctgggattacaggcacatgccatcacgcccggctaatttttctatttgtagtagagacaaggtttcaccatattggtcaggctggtcttgaactcctgaccttagatgatccacctgcctcggcttcccaaagtgctgggattacaggcatgaaccaccacgtctggccttacccacctcttttttctcatcccaatggcatccctagtcccaaccttccttttgtttctagtttggttttcctggagtcagcagggcagtggcaatggcagaagtggatgggagagacttgccagggaggcaagaggactttggcaactgtggtgcctccctggaacccccaactcatctcctcttcagaccgacatgtgaaagcctccagaggtcccagcccttctccagcatcacagatgacctccagccctgcagggagccgctcaagtctgggagggcatgggagcagtgagcaggcccatggggagaaattggccaatttaattcagaggggtcttaaagcagggctgggccggagggtgtgggtccatattaaagaagcaagggtcttcccatacccgggggacccctgacaaacctaccaggcctgaccaagtcattcattcaaccagcgtaggtccgagactcagccctggccctgattcaagccatctaggaccttcttgggaatgcccaaccctcttccatctgttcaatggggatggggggcttgctctgaacttccattctctgatttcaaattcgctccttgattggacttcaggctgatcttaataacaaatatttgataaatagctgcagagtgtctaccaagtgcctagtttggtaggagcaggaatagctataggagtagctcaacatttagtgaatgcttactacacgtcaggcacttttctatgtgctttatacatacgattgctggccgagcacggtggctcacacctgtaatcccagtactttgggaggccaaagcgggtggatcacttgaggtcaggaattcgaaaccaccctggccaacatgacaaaaaccccatctctactaaaaatacaaaaattagccaggtgtgatggctcacgtagtcccagctactcgggagactgaggcacaagaatcgcttgaaccagggaggtgaaggttgcagtgagctgagatcgtgccactgcactccagcctgggcaacagaatgagactcggtctcaaagaaacaaaaacaaaaacaaatacatacgattgcttttagcccttgtaagaattctgcaaggtaggttggttacctctgttttacacatggggaaacaggcacagagcagttagtaagttgctcagagtcacactgggagagttggcatttgaacccaggttccatgactccagaaccaggtcccactccactgtgccagttcttccccaggtggggtgctgggggaggtatggtgggaggcgtaagtttccagaggctgcaggatgatgggggtggggggataaagggacaggccctccaaggtaccaactgggcatcatctttatcccttctttctctctcactccacaccccaccagccaccacgacttctaaatgtccaaggagagagaattgagcctgaaatcttagcttgtctcctggcctttggtctcctggccttggtctctgctctttctgccctgttggagtgatccacccaaagcacaaattgggacatgtcccttcctggcttcacgtcttccatgctttccgttgtccgtgggctaaagtctgagctcctcatcaggtgcagaaagccaccttttgggatttgagccccactgaatttgctggatgaggtttctattcttacccacaggctacaatgaacactcttgaacctaaatccttgcccacaagtgtgcttctatccagagaacacattctgaaaggagaaattgttgaatataagacatgcatttacattttgcagaaactaagttgctcgaccaaaaagtggccccaagggtacattagaagtacctgtttccccagtcctttgccccgctgtgcaatcccaacatgctctcttacatacagacacacacacgcattatcacacactcacacacaccctcatacacacactctcatagacacacacagacacacaccctcatacagacacacatacacacacacaccctcatacagacacacatatgcacacagacacacaccctcatacagacacacatacacacactgtcacacagacacaccctcatagacacacactgtcacacagacacacatacacagacacacaccctcatacagacacacacatacacacacacagacacaaaccctcacacacactcatacactcacatacatatacactcacacacaccctcacacatacacactcatacactcacacatacatatacactcacaccctcacacatacactcactacacccacatccacatgcatacacacacatatgctctcagacaccctcacacatacacgctatcacacacagacacacacactctcatacactcacacacatgctcacacatatccactgacacaaacaccctcacacgtacaggcacactatcacacacagacacacacacacactcatacactcacatatacacactgtcacacagtcacactcatacccacacacacatatacactcactcatacagacacacatacacacaccaccttatacacacagacacactatcacacactctcacagacacacatgcacacacgtattctcacacatttaaatattttgttttccatcaggctgtggctttgaaatgagaatgagaaggaaacctgggctagacacacatccatagacacgcgcactcacacacacgcacacacacccacaaccctcccttctccacacaagccttgctccagctgatgagcttttgtcaccacggggttttcctgggagctgcaggggtggcgttgaatgaaccctgttggcaactcctccctgtggtggaagctctgcctggcattgtctgcatttttgccagatgccccgttctgtggagtctctgtgcattgcttactcggccctgccccactgtgctgtgaggggctgctgggccattgttcagcctcccttctggcctagaaaagccagcagagccccccagccctcttgccccacctgctgaggaggcaaccccgaggagagtgagtgcagtgggccctgcactggggtctggggagagcatctgccatgcccctggaacctttgaggcagaaggcagatgaggccgctcctcagggccccgggcaggtgacagctctggagaacaattgtggggagtgtggggagacgccttccctgctttggtgagggctgagaccccgggcctctacggatgtggacgaggtccccattctggcacacacagacacacacacgcacacatgcacactcatacagaggagatgggcatgtgactggtaaacacatcccatgacactctagtcacaggctcccgagagacatcatccccacgtagcagccacggctgagtgcccatgcattatcccactggatcctcacaacagccctctcagtcgcgtcatggttccattttcagacgaggaaactgagattcagagaggttaagcaactcgcccaaagtcacacagccatgaagtggctcatttttctgactcttaactgggatgtgtgtctccagatccacggggatgcccctggctcttcctagagctgaatgatggagcttaaggctgtgcggttgatgtttgtaggaaactcaggtgcactcgggaccgcaaacctgtctccccaggctgaggggcgcagggaccctgcgaggacagtcaccagcatgacatgggagcaccgcaggggcatcagcaaagcagggtgtatctgactgtcggtgcatctcattgaaagccacaccccttgtcacagcatatcttctaggcacaggcttattttctacccctaaccctggggccacaggcctggactcccgagtgcaagcccatcaccatcccattcagcctcagtgtcatcgtctgcaaaacggccaatcccctctgcatttgcttccaggagctcccatgacagagtgtcacaagctgggtggtttagaacaacagaagcgtgtgggctcttacttctgggggctagaagtccacagttatggtactggcattgccaggctccctccaaaccctgcagaggaaggagccttccttgcctttcacaggttctggtggctccaatgtgcctcagcttgtggcagcatcacccagctgcggcctctgccctcacatagtgtccccactgtgtgtcttcccatcatcttcttgatatgcacacctgtgtcggggaccgattttcccctttcagagggacaccagtcttattgggttagggcccaccctaccaaccacattttaacttgattatctctgtcaaaaccctatttccaaataaagtcactttcatgcgcgtccatgtgaagagaccaccaaacagcctttgtgtgagcaacagggctgtttatttcacctgggtgcaggtgggctgagtccgaaaggagagtcagcaaagggagatgggggtggggccgttttataagatttgggtaggtaaaggaaaattacagtcaaaggggggttgttctctggcgggcaggagtgggggtcacaaggtgctcagtaggggaatttttgagccaggatgagtcagaaggaatttcacaagataatgtcatcagttaaggcaggaacaggccattttcacttcttttgtggtggaatgtcatcagttaaggcaggaacaggccatctggatgtgtacatgcaggtcacaggggatatgatggcttagcttgggctcagaggcctgacattcctgtcttcttatattaataagaaaaataaaaggaaatagtggtatagtgttgggacggtgaaaatttttggggggtggtatggagagataataatgggtgatgtttctcagggctgcttcgagcgggattaggggcggcgtgggaacctagagtgagagagattaagctgaagaaagattttgtggtaaggggtgatattgtggggttgttagaagaaacatttgtcatttagaattattgatgatggcctgaattgtcatttagaattattgcatgaattgaaaaactaaacggaataagagaaggaaaaaaacaggtattaaaggactaagaattgggaggacctaggacatctaattagagagtgcctaaggaggttcagtatagccttgccagcaaagattatttatttactttaagagttaagagtggcggtttggggatagcaccaggagatatcagctgtgatggcttgaagaaacagtgtaaactggcagtgtaaacaagagcagggcatgtatgagtagttgagaacagtgaataggagtatgactagatagtagggatgacaagttttttggggcacagtccaagttggtctggtgtctggaatgagactggggcctaataaaaaggagcgtccatgcagaagctcaaatgggctgtaccctgtagcattccgaggacaggcctgaattctgagaagggaaagtggtaaaagtattgtccagtcctttttaagttggtggctgagcttggtgaggtgtgtttttaagactattagtccgttctacttttcctgaagactgaggaccttaagggatataaaggtttcactgaatactaagagcctgaaaaaatgcttggctgatttgactaataaaggccggtctgctatcggactgtatacaggtgggaaggccaaacagaggaattatgtctgacagaagggaagaaatgaccgcagtgaccttctcagaccctgtgggaaaggcctctacctatccagtgaaagtgtctacctagactaagaggtattttagttttctgacttggggcaaatccctgagcttgatgtgtagggaagggagggggcctgaataatccctgaggagtagtagaatagcagatggaacactgagaagttatttccttgaggatagatttccacgatggaaaggaaatgagaggttctaagaggcgggctagtggcttgtactatagcatagcctgccttcgctggtgtgtggcgattaggcctggtggaactgccatcaataaaccaagtatgatcagggtgagaaacagggaagaaggaaatgtggggaaatggggtgaacgtcaggtggatcagagagatgcagtcatgagggtcaggtgtggtatcagtaataatgtgggaggccagattgaagtccgggccaggaacaatggtaattgtgggagactcaacaaagagtgagtacagctgaaggagccgcggagcagacagtatatgcgtcaggtgtgaggaagaaaacagattttggaaattatgagagctgtagagagtgagttgagcatagtttgtattttaagggcctctaaaagtattagggcggcagcagccgctgcacggagacgtgatggccagcctaaaacagtaaggtcaagttgtttggacaaaagggctacagggcgcgatcccggtcgttgtgtaagaattctgactgcacagccttgcacttcggctgtgtgtaatgaaaagggctgggataagtcagggagagctagggtgggggcagtctctaaagctgtcttcaaggaatggaaagaggtgtggggaaaggatttaggatttatggagtcagctaggtttccttttgtgagtttatataatggtttttttaggatggcaaaaccaggtatccaaaggcgaaagtatctaaccatgcccaggaaggaaaggagttgttgttttgtagaaggggttggggtttgagagatcagtcagacacgatcggcagggagagcacatgtgtttttatgaagaattatgctgaggtaggtaacggatggagaagaaatttgagctttgaagggggatacttggtatcctttggagaataaatgctgaaggagcagaagtgtgtcttgttgagaagattcaaaagaggggcaacaaagaagaagctcatcaatatattgaataaggtgagaagcggaggggtggaaagaaagtaaatcatgagaaagcttggctgaagtaatgagggctatccctgaaaccttgcggcagcacagcccaggtaagctgctgggactgatgggtgtcagggtcagtccaggtgaaagcaaagagaggctgggatgaggggtgtaggggaatagtgaaaaaagcatctttaagatcaagaacagaatagtgagttgtggaggaaggtattgagaacaaaagagtgtacaggttgggcaccacagggcggataggcaaaacaatttggttgataaggctcagatcctgaactaatctgtaaggcttgtgtggtttttggacaggtaaaatgggggaattgtaaggagagtttataggttttagaagcccatgctgtagcaggcgagtgataacaggctttaatccttttaaagcgtgctgtgggatgggatattggcgttgagcggggtaaggatgattaggttttaatgggagagtaatgggcatgtgattggttgccagggaaggagtagagatgtcctatacttgtgggctaaggtgggggcatacgagaggaagacacaaaggaggctttgggttggggagaagggcagcaatgagatgtggctgtagtccaggaatagtcagggaagcagataatttggttaaaatatctcggcctaataagggaactgggcaggtggggataactaaaaaagaatgcataaaagagtgttgtctaagttggcaccagagtgggagagttttcaggggttttgaagcttggccgtcaatagttacagcagttatcagggcaagggaaacaggcccttgaaaagaaggtaacgtggagtgggtagcccccgtatcgattaaacaggggatggacttaccctccactgtgagagttacctgaagctcggcgtccatgatggtccggggggcttccgaggcgatcgggcagcgtcaatcttcagtcgctaagccgagcagatctgagaaggagtcagtcagacagccttgggctagagctttaggggctctaggagtggctgccgggcgagctgggcagtctgccttccagtgggtccttccacagatgggacatggcttgggagaaatcctgggctgcgggcattccttggcccagtggccggatttctggcacttgaagcaagatcctgatggaggaagtcttgtaggaatgcttgactgctgcggcttaggtgtgtgcggcttaggcattttgaagttcttgtgtgctggaggtgtggctgggttttgtctcacagcagaggcaagtaattgtaactcagacatgcgttgccgtctggctgcttcctctctattactgtacaccttgaaggcgaggttgatgaattcctgttgtggggtttgagggccagattctaatttttgaagttttttcctaatgtcaggagtggattgggtgataaaatgcatattaagaataaggcggccttctggcccctctgggtctagggcggtaaagcgtgtaagggtcgctgccaagcgggccatgacctgggctgggttttcgtctttacctcgggtagtttctctaagtttgtcagaattaccagctttgtaagctgcctttttaagcccttcaactaggcaggaaatcatgtaatctcgcctagctgtacctggggaatctgcctgatagttccattgggggtcctctcggggaactgctctactgccttcctggaggtcaagttcatgaagccggcggttatcagcgtgagattgggctagagaaaaaactctttcccgttcatctggggagagggtagaagtcaggatgacatttcagtcactccaggttaaactgtaggacagagttagatattggaattcctgtatatgtttagtggggtctgatgagaaagagcctaaatgctggctgatctgagagaggtctgacagagaaaaaggtacatgtaccctgactatgccttcagctccagccatctctctaagaggaaattgtgggtaggtggggaagagcggaactaaactgtaagccggaccgggtatgaggaagggaggtggtagaaggattatagggtggaggagtggaggctgaggaagaattgggacttagctcggcctggcgacgagcagcctggggaggaggggaagagtcagatgaatctgtagaaaaggaagactggaaagactcagcgacacttggggttgggactgaggggacaggcgggagggaaagaaggaggatttgggaggaatcgcattgggaacagagactagggagggaacgaagtgtgaaaaatgtctggatgtaaggcacctgggaccatttgcctatttttcaacaaaaattatttaggtcttgtaggatggagaaattgaaagtgccattttctggccatttagagctattgtcaagtttgtatcggggccaagcagtgttgcagaagaagataaggcatttaggttttaggtcaggtgtgagttgaagaggttttaggtttttaagaacacaggctaagggagaagaaggaggaatggagggtggaagtttgcctatagtgaaggaggcaagcctagagaaaagagagagtagagacatggagggaaggggttcgggggttcttaccttccagaaaagcgggaaaggggtcagcgcgcagaaataaggggttggggcacagagacaagaggttggggcacagaaataagggattggggcatggaaataagggatcggggcacagagataagaggtcggggtatggaaataagggatcggggcacagagataagaggtcagggcgtggaaataagggatcggggggttcttgccccccagaaaagcaaagaaggggtagaacacggagagagggagttgggggattcttgtaccccagaaaagtggtacttgctgctaagagtgaaggaccaaggcaggtgtccctgtgtggtcagacacctctgaaatgtgggtgaatgatcagagaggcatccctgcaatgattaaacaccaaaggaaggctgccttcccgagtccatgaccggtgccgggattttgggtccatggataaaacgtgtctcctttgtctctaccagaaaatgaaaggaattgaaattaagagaagggagagattgaagtgtggtgccaagattgaatggagaaagaggttgagggatagtgagggaggttggagaagagagtaaaaacaggctgcttagcggatttaaaattggtgagatgttccttgggctggtgggtctgaggacccgaggtcataggtggatctttttcacggagcaaagagcaggaggaaaggggattgatctcccaagggaggtcccctgatcctagtcatggcaccaaatttcatgtgcatccatgtgaagagaccaccaaacaggctttgtgtgagcaacaaggctgtttatttcacctggatgcaggcaggctgaatccgaaaagagagtcagcaaagggagataggggtggggccgttttataagatttgggtaggtaaaggaaaattacagtcaaaggggggttgttctctggcgggcaggagtgggagtcacaaggtgctcagtaggggagcttttgagccaggatgagcccggagaaggaatttcacaagataatatcatcagttaaggcaggaacaggccattttcacttcttttgtggtggaatgtcatcagttaaggcaggaaccagccatctggatgtgtacgtgcaggtcacaggggatatgatggctaagcttgggctcagaggcctgacagtcacattcagagctactggggcttaggcattcacatgtttttcatatgtttttggtaggacacttgaacccataacactctcttgagagtttatcatgaggattgaatgtggtaatgcatgtaaagctgtgatcacagtgcttggctggcacttcattccataaattacttttgaaagaaaaaattggctgggcatggtagctcatgcctgtaatcccagcactttaggaagcggaggtggaagcatcacttgaagccaggagtttgagaccagcctgggcaacatagtgagacccctgtctctacaaaacaataaataaaaatggctgagtgtggtggcacacgcctagtaaatcctagctccatccagagactgaggctggaggatcgcttgagcctaggaggtcaaggctgcagtgagctgtgatcacaccactgcacaccagcctgggtgatacagtgagagccagtctcagaaaagaaaaaggaagaagctgagcacctggaaattagatgctctatgtacattgtgtgccaggccccatttaagtgcttgatgtgtattatcccaccaaatcctcacaaccacccctcaagccaggcaaggttttcatttaaatgatgtggaagctgtgactgagagaggttaaggcatttgcctgaagtcacacagcctaagtggcagagctgaggatcagcctgaagcctatgaggctccacctcatcacactacataggactgtgctgtagtgtggagtgggggctgcttggaggggcagaaagccagggaggaaatgctgagcacacagcacacaggccctggggggctttctgggtctgagggacctggaatgagtctctgcgatagtgagaggcctagctgatggcaggctgcctggggaggtgctggcgagctgccagggtgcagggccaacaggtctgagccactccactgtgacctaaccggcctggccgatactgcaggtggggggctgggacagggctcagccgggggtgaggaatgttgccctgagcgtgggtacactcacttctccaggcttcattctgagtatacgcgcggctctcccggaagcgaagagggcacttccttacagaggcttgaaagtgtggtcatccaagattcaggccactctctcttccttcctgctttcttctgaaaggttccttgcacctaaggaaggtaacaatgaactatgttttcagtctggactagaagttcatttacccaggtactaacttgtttactcactcaagcatttattcattcattcactcatttactcttccccccattcacctaatggctcactgattcattcattcactcatgctctcacatattcatgcccacagccattcactcttccacctacccatccacctacccatccatccatccatccatccatccatccatccacccatcaaaccaaccatcaacctcttattcaattgccttcccattcatcccttctctcatcccccattttcccaaccaatctttcattctttcttccatctatctatgcatccatctatccatccatccacccaacctttattaagcacctaccatgtttcccacccaaaactccctatggctcccaaagtagttctgcacccacttcggctgacaattcacctacatattggaccccagctccttggcctcacagtggcatggttcccttgtctcctcctcaggaggaggctcaggagaagtggatgggtggtcttctgcacagccctggtctgcaggttccagccagtgacagccacctgaaacttggggtttttcaggaccctttgtgttgcgaggcctttcccgtctttaatgccagaaccatgcatgctcctgggctctatggctcccgtggggccctgttttcagtttcttggggcccatttcttgcctccctaaggccagaacagagcttcagactgtggggacccatagacttgggggccctccttgatgaggactctggggcctctcttcttggagtacaggtgaatatgcttcctggaaagattcactgacacccggaggcttagaggagggcagggcgggcccgggcaatctggggaagtctatggcattcagtcctggccagagggcaagagaaggggctcatggtccaaaatggatgcagggaataggacaccgccagggaagctggcaggagcgcttctcatacgttccccaaatgccctactgcaacaccttggcttgtgtccttgttggcacctggaaaccccttcccactccccaccctgacactcagcctctgctctcctctcagctgagtccacactctcctgctctttgctttcagacactctggtcgccttcccccagggcccctacagagctccataaagatttgctaagtgaatgaatgagttctcattttacagaagagggggttaaattccctgggttttccccttacccagcctttccccagctagttcctcctcctttacatcccagccaaaagaccaatcccgggaggctctccggacgccccctcactttgccactcccatttcctgctcccttcctatcctcccgcccccgtgcccaggtcctgctctctttacaccctgacatcttcctgcttgcttttttcctgtctcctggcaaatgtcaccatccccatttcacagaggaggaaaccgaggctcagagaagcctcagagggaatagcccagccagataaaaacccctgggtcgtgagcacgttcttccacccatagtagccaggtgctttattcatgtggttttactctgaaatcgggatggctgtaggtaataatagtggccatgcaaatcatatttcatgacagtttttgaaaggcgccgtttccacctcgcagttccagtgcaggcgggtgggactcagtggtgtgtgtgtgtgcggcgagtgcctgcctgtaggtggccccggccaagccagccccgccccaggaggaggctgaacattagtcctgcatgagggtgtctgggaactgggtgcgccacgggggccctacctcactcctccctctcacattgccgatcgagtcagccccacggcggcagcaccacgaccgaccgggatcctcgaggtgccagcccatggccgagcctgccctcctccccgccgcccagatggagaggctggccccagggcccctagcctcaccgtgtcctcggatcccgcgggcccgcattgccaggcgctgcgcccagcgctgggccgacctgggctgcaggtacaggggtcacgggagcgggagggaagttggccctactatgcaccaggggcatgtgcggtctgtcttcacaacatccctgtgaggcaagaatcttcctccatcgtacagatgaggaaacagaggcttggagagcccggtcacctggctgtcaagtggtggagatggcttttagccctagtccatgggactccaaacccagagccttcctgggacacagcattgccctgggttcaggctactggcctcctgcaggggtcactgattttcagattcttagagaccgtgagtgacgccagtatgtgccatttcctcttcctctgggtgtagagtcttagggggcccaggggctcaagattcaggagtctctgggtcaagtttctgggtcagtgtggccgtgtggtcacctcggctgagaactggtcaccccttattcctgctcagcctgccactgacagccagaccagaattttcaaatagtcatttcccccactctgattacatcatattacaatttgattattatagaaagtcaaacagtgcaggaatactgtacaggaatacatatgttcattcttgaaaacttactactgttaaagttttgacatataccttgggagaactttttgacatatgtaaacctaaacttgtatagttttacacaaataggctcttgtgttacatgtgcttgtaaggttttcccctgcaacccctcaattaatgttatggacatatttacatgtcagtaacataaagatccaattcattcactttagtggcctgccaggatccaactttatggatatctttggttaatttgaatcagttcctggctaatggacatttaggttggttccaatttttaacgattctaagcaatacagcaatgaacatctctggggacttgcatgggtaaaattcacatcctagacttgtagttgcaagtttaaaaggaatgttagaatctgaatagaccctgccctccaaaagtgttctagcttggaacacacctgcagcaggagacccccattgccccattcatttgccacccaaggacctgaagactagacgtggtctgtactcagaaagcagattcagggagcaggtgatcctgatcgtaggacaactgagtcctagaattcccttaagggaacaacttctaggctcaggaaagggagggggagcttagtgagaccatttcattcatacagcatgttcgctgagctcctatgtgcgtggggctctgccccatcacaggcaaaaattactcaggataggattttaataagaatcaattttaagaagccaaagacaagtttgtttatctgtctatctatctatctatctatctatctatctatctatctatctatctatctatctattctatatctaatctatccatctatctatctattctgtatctaatctatctatccatctatctattcatctatctatgtttcctattgctgctataacaaatcacataagcttatctatcatctctctctctgtctctctctctcatttatattagttttctattgctgctataacaaatcacataaacttagtagcttaaaacgacacaaatgtgttatctgacagttctgaatgctggaaatccccaaatcgaggagtctgtaggggtgcattctgtctgggggctctagcaatctgtttccttgccttttccagcttctgcagctgcccacattccttggctgatggtcctcttccgtcttcaaaggcagctctgtaacatcttcacacatctctctgactctgacctccacagtcatccccatgtctccttctctgactctcctgcctccctctttcattgataaggatccttgtgatgacattgggcccactggctaatccaggatcgtccccccaactcaagatccttagcttaatcacatatgcagagtccctttgcctgataacatatattcacaaatactgaggattaggatgtggacatcttggggagctgttattcagctgatcacaccatctatccaaccatgcgtcgtccgtccatccatctatctacctatctacctacctattatggctgttcccctgactccaccaccaccctcccttaatctcctggttccttgtgatctttgaggcaattaatattgaattcactataagagctcgtgacccattgaatgtgcttaatagctactggttgaatgaacagatgaaaaatacttaagagagtttaaaatttgaaccattctgtttattactgaaaacaaaacaacaaaagcaacatttttacttccagaacagtggtgttttttttttttttttgagatggagtctcactccgttgcccaggctggagtacaatggcacgatctcggctcactgcaacctccgcctcccgggttcaagtgattctcctgccttagcctcttgagtagctaggattacaggcgtgcgccaccacgcctggctaatttttgtattttcagtagagatggggtttcatcatgttggtcaggctggtctcgaactcctgagctcatgatccacccgccttagcctcccaaagtgctgggattacaagcgtgagccaatgcgcctggcccagaacagtggtttttaaaccagggttctgcaaacattttatttgaatttaatttttattatatctttcaagtattaaacatctagtaaaaatactacctccactcaggtatcccaaatgttttttgtcaactaaaattatcttgattgtatgatcagtaaatgctttaaattaaacttataaaatcagcttataataatatcaccgttacctcttttgtttattgagaagacattccactgccaaagaaaaaaaaaaaagcgaaaactacttccctggaacaaggttggtctgtttgctccaggctaatgttcttgtgtattggctcacaaggtcactaggtcagctcccccaatcctttgagtctgttcatctcactggtcccttgcttgtgagtcatttagttattcaacaaattccagcaggacggcaaccttcaggatgtaagcccggatctgttctgtttacccacagctctccagcactggcacagggctggcttgttgtaggtgttcatgaaatatttccctgatgaatgaaatgctcactgcctctacatgaagtcctgtgatggatatgagggtgtgggcatgaataagatgctctctcagcccttaagatgtccacaggctggtccaggaggaagacataacactggtcactaccacataatacactaaatgctgacctgaaaggcctgagcagggatgaatagagtcaatgttgtcatcaaacagaacatcccataatgtgagggggacaccgaattcactgtctatgtggacttcatcttaaaaccatgcaatattggccttgggaggtgcctcaaagacccagttggagtgaggtgactctgttgggattccccttatccttgctccctgtagaaatatattttctgttaattcatgattggtataaaaatgcaaaaaaagtagcaagtgaaatccacctgcccctcccacctccaacccacaagaacagcaattgtgagaagttaagtgtacatcctataggattttgtgcttcataaatatttacatacatgtatacgtaaaatgtatctatgatccaatccatgcacataattgtacttacatacgtgaattggtttgtattatgtatactattttataaatgacatttccatctttataatatcttttcctggaaagacatagaaatcaacattattctttttttttcttttggagacagagtcttgctctattgaccaggctgaggctggagtgcagtggtggaatcactgcagcctcaacctcccaggctcaagtgatcctgggaccacaggcatgcaccaccacgcctagctatttttttcatttttgtagagacagggtctccctatgttgctcaggcttgtctcaaactcctggactcaagcaatcctcctgcctcagcctcccaagtaggtgggactacaggcatgtgccaccacacctgcccttacgttatcctctttaaagactgtgtgatgtttcattttatgactggacagtacttttgttaactagcctcctgttgatggaattttaggttgcttctttttctcttttggttgctattataaactatactgcaatgttcttggacatatatctttgtgtacttatgatacattttcagaataggaatcatggagtccaaaggtgtatacatttaaaattctgaaacatattctgggtggttttccaggaaggttgtacccaattagactcaccaagtgggtgtgagcttgtttcctaatatacatgacattcttgaccagacattattgttcatttttagtcttggctaattggattgggagaaacctgtctcttgttttaatttgccctttttattattattagtgaggctgagcatcttttcacatgctcagtgtctggcagagttcaaaggcagatcagagaggcagaaagacccattttgagtctagtgcaccagccagatttccttaatcaataatgggttaaatgacttggctgattgcacacagatagcttgtagaatcaatcacctttacaaggttcaccttcactcatattttgctcatgtgtagctcaagtctctgccactggggtcaatgtcaactgatctctccagacacacccccttgtatgtgaacgcaaccactgaataaatcacctacacatggtttaaatatgtcaggggtagaaggacagcctgaatctgaaagcccagcttcaccacttatcagctgtggacctctggggaagttacttaacctttctgagccttggttccttttctgtaaaatggttgtgaacagcggtacctgcttcatagacttgttgtgaggataaaatgacattaatgcatgtgagggcttagtacagtgcccaccatttagaaatgggacaatttgtgtcagatatcagtggtcaaagggcaagttcttggagctgactccaaatagcacaggcttgttttcatgggacaagtacattcgggactcctgactccttggcatagcagaaaaatttgcatttgagtcctaaatcctccactcatcattgggaaagttccttcatttctctgggcctgatccttcatttgtggaatcagtgccattcagatagtggctgccgttcacactcacacatcctcctggttcgaaacccggaacggccacctcagatccgcagctcaggggaccaggctgccgctgggggcttctgaccagctttgcaggaaaaagtccttgcaaaccactttcctccagggctctccagcaggaggggcctcctcagatcctgcttacaaaccagcgaagggcaggtcccttcggatggagcttcctattttccctcttttctcacaatgaagcagaggtgaaggtgttaattacaccaagcagttaggctgccgcccttcacaaccctggggtcctcaccctgcctgcaatgtggaggccgcttctccacctcccctcctgtcaggcgtcaccgactcttcccaaattgaccagcagatgctcatccaagtgtgagaaggtcttttctcgatacttgccagtactgagtgttggcaatcttttctgtgtttgccaatctgatagagttcatccttgttttatttcgcattgccctgattacttgcgaggctccacatcttttcacatagggcatttgcattttatctcctgtgacttgtggatttctatctgctgccaactttcccagtagattttttgggtattttttttcttgttgctttccaggaactctttatatatatagactgaatagtaacactttatcatttgttgcagatatttcctctcagttgaggaaaaaggtcctatgacattttttatagtgtcttttgtcatacaaaagttttaagtcttgatgtaatcaactcagctttcttctgttatggcttctggattttaatttgtttggagagttgttctgcactaccatttatttcttactgactttgttctcattaaaccctaatacagacttctatccacccagggaaaactttgcacttcccagcataaagacctgctccccttcctgggagatttgcatatctcatttcctcccagacattcactgacttgtttctttaaaactgagtttcaacaccacctcctccaggaagcctcttctcagcccactcccccttttgttctctagttactactctgtcccctcgggctgtttgccccatcttaagaggactgttggctgctggctgctcgttggtcggaaggcagccttgtgttttcatgtttttggagtacttactatgggctgaatgttttacaggccttactttatttcatcctcactgccttctgtatactatcacacaatcaccctgattttataggccgcacatcaagaggacagacctaggcccagacagtgtgacttcagggccttggtccttagccactatagtggctaaggtgacttagggccacaaatttagtggccctaatttgggccgttggggcggtgaaaaagggccacaaatttagtggctgaaacaatacaaaggtattatcttagagttctggaggtcagaagtccaaaatgggtcttactggtctaaaaatcaaggtgtcggtaggactgtgatcctttctggaggctctcggggacaatcaattttctagcttcaagaagccacctgccttccttaagttgcggtccacctgcatctgcaaaggcaagagtggccggctgagtccttctcatgctaccatctctctggttttcactcttctgcctccctcttccccatttaaggaccttagtggtttcattgggcccactcaggcaacccagaataatctccccaaaatcagctgattagcaactgtaattccatctgcaaccttcatcccacctttgccatgtaacacacacatttacagattccagggagtagtgggtagtgggggggttattctgcctacccgcagtcacccttccatattgcttttccaaacttcagtcccctgcctccaccctcaggagtcatcctgcctccctccaacctggggcttagatcagtgccttggagtcacctggaaggcttgtgcaaacacagattgctgcaccccacccccagagtttctaattctgtagttctgaggcgagggctgaaaatgtgcactcctaacaggctcccaactgatgctgatactgaaggtctggggcccacactttgagaaccactgggttaagtttattaatccttcaaatatttatcaatatctgctctgttttgggagctgggcttatacaataataaaaagaatgtctctggtctcaaagagatcccagactaaaggagaaaacaaacaggcaatgaccatggagggcggtaagtgccaggacatcaatgagcccaacgcctctaggagggctgcagagaaggcttcctggaggaggtgatgcctgagctgagtcccaaagtaggcactgagcaggccaaggatgggaaggagaagggtgttcctggcagtagctgccaactgggcaaaactccagggcaagagggagcctggtgcctctgagaggtacacgtagctcacactggctggagcagagagtggggcagaggagagatgggattgcagtttgctttcaagccctgagcccggctgcaaccccagggccaggagacctgaaggtaggatgacaatctggctcttaagcccttgagtgcgtaatggaagagtgagcaatgaggacctccctgtgaagatgtgcagcaaagacagggataatgaggccatgcctcacccctaggccagcctaagaggaggtgtaaccatggcaaccagcctgatgctcttcctgctggtcttttttgaaggctttaaagaccagatgttcttaatctggggctcaaggatggaccttcaaagatccgagaaccactaaaattatttggtaaatgttatgcatctctgtgtgtgtgtgtggttctccggagagaggatccacaacttacataagattttaaaaagctccccccactgtgccacccccctaccccaaaccagctaggaagatgttatagaccaggagttgtaaactctggtgcctacaagggttaagtgggaccctcagggagtcacgtggcagagtgtaacatctcagggcatggtgaggattgtggaaccaaggtgtgaatgggaaaaccaagctctgtaatatattttaaggtttattctgagccaatgtaagagaccctggcctggggaacacagtctcaagaggtctgagaaggtgtctccatggcagtcagattacagtttggttttatgcattttaggggagacaggagttataggcaaagacataactcaaagcatagaagctgtataatggtttggctggaaaaggcggcatatcttgaagccggggcttacagattatacgtggattcagattctttaatttgcaattggttagaggagtgaagcttcgtctaaaaatttggagtcagcagaaaggaatgtttaagagaaggaagtctgttaaccaatataccagttcagagttgctcgtaggggtgtgtgagttcacctttgtctggcacagccataggtcctgtttataattggttatcttattgtcacaaaaagtctgttttgtcaatcttgtgatgtcttttctttttttttttcttttttttttttttgacagagtcttgctctgtcacccaggctggagtgcagtggcaaaatctcagctcactgcaacctccacctccggggtttaagcgattctcctgcctcagccttccgagtagctgggattacaggcacccaccaccacacctggataatttttgtatttttagtagagatggggtttcaccatgttggccaggctagtctcgaactcctggtctcaagtgattcacctgcctcagcctcccaaagtggaggcaaggcgtgagccaccatgcctggccattgtgatgtctattttaacattaatgctggtcagatgctgtgcctaaactacaaaagggaggagcgtataatgaggtgtgtccaacttcccaacccatcatggctacgaattcagttttgcaggtttccctgcgattctcttggccaagagagtggatctgttcaattggctggggggcttaggattttatttttggtttatggagggcactaagcctatttaaaactttttttttttttttttttttagaaacagggtctcactcttttacccaagctggagtgcagtaacacaatcatagctcactgcaacctcaaactcctgggctcaagcaatcctcctgcccacgcctcctgaacggctgggactccagttatgcacaaccacacttggctaatttttttttttcagacggagtcttgctctgtcgcccaggctggagtgcagtggcaccatcttggctctctgcaagctcccgggttcacgccattctcctgcctcagcctcccaagtagctgggactacaggcgcccgccaccatgcccagctaatttttttgtgtgtttttagtagagatagggtttcactgtgttagccaggatgatctcgatctcctgaccccgtgatcctcccacctcggcctcccaaagtgctgggattacaggcacgagccaccgtgcctggccacacccggctaatttttgtaattttttttttgtagggatagggtcttgctgtgttgcccaggctgatttccaactcctgggctcagatgatcctcctgcctcagcctcccaaaacgctgggactacaggcatgagccactgtgcctggtctaaaacttctaatatgatcaaattaacaacattaatacttaatgttattttaataaaaacaacattttatgtaacccaatatgtccagaatattttcacatgtaatcaatatgaaacattaatgagatattttacattttcaaatatgaagtcttcaaaatccagtgtgtatttttcatttccagcaatctctgataggatgctaaattttcatcagaaatccttaatatatatttagatttcataaaatatacagccagaaaagtagatttgtgtacccaagttgttctaaacatatttaggccttttccagtaactgaaacaagtatgtagttttaaatttaaattggttaaaattaaataaagttggctgggcacggtggctcacacctgtaatcccagcactttgggaggctgaggagggcagatcacttgaggttgggagcttgagaccagcctggccaacgtggagaaaccctgtctgtactaaaaatacaaaaattagctgggcatggtggaaggtgcctgtaattccagccgggaggctgaggcagaagaatcgcttaaacccaagaggcagaggtttctgtgagctgagattgcaccactgcactccaacctgggcgaaagagtgggattctgtctgaaaatgaaagaaaagaaaagaaaagagataagaaaagaaaaggaaaggaaagaaaagaaaagaaagaaggaaggaaggaaggagttaaaaattcagctcctcattcatactaaataccatatttcaagggctcaggtggctagtggctacaatattggccagtacaaatcaagatgacaatctaagtgactcaggaagggacacacaaatgtctataatcttgttcgaaggaaggatcagggaaagcctacacaacttaaggactttcgaagcttctctggcaagcaccacagggctgcgctgctggctggaggcctgttttaagaggcagccaccacttggcttcagccaattgtcacttagagacacagacccaggattatcatctctactgattattttttcccaagggaaattggaaattagaggacttaaaaatgtgagacctcctcattttcaaatgatggcaagctatttaaaaggtgtgaaaatccattgtgtgtgttggggacgtggtggggggatgcagtttgctatctcagatggagattggtagatcctgatcttctgttgggaatatttgtcgtctcagaggtcatgggcagtaccttaatctcccccatccatctaaaaaatgcaggctgcccctcccagagtgctatgtgagaattctgatgcaatccatcagttcccacccaactcttgaaacctatgcaattctctgaaccccagcaacataatgatactcctggctttccaaccctggttgcacaatggaatcaacaataggtgcccaggtcccattcccagcagtttgggtgtcattggtctggctggggcattgcttgggcataatggcctggcaaagcttactgggagattccagcccatgggcagggtggagaagcaccctgccctggagaaggtctctgggccaggtctccacacctaggatgcagcttcttgggcccagcgtgggtcctctgttctgatttgtgcccaacttgaacagctaaagggggcacccatagctgtgccttccctgtctctcagcccaggctcctgtgtgattcaggaagctaaattatattaattacatttcagaatgttttattcttgttgtctataacacaaaatagccatgcttgtgactttcataacccacagatcggctctagcagaaatgctgtgtgaaagagatatggcgagcatcgtttaataattcaaagaatggtcacactgtccagaatgagccagtcttctttgtcttaatgggaaagttgtagccatagagggattttaggagctcagttaagatgatactcaaaaatgtaaaggtaagatttaccttttataacatctcattcccacccatcccaaccctgttgccacaggggttgcttcgtagatgtgagtgttgctgtgtcccgatgttcaggttgtgcactgcatgtgagtgttacactcagaggggcaccatttacgtagtcatcatgtactaagttatgtgagtgatatgggtaggcatgaagaatccagacctcctggcaagtcctgaggcaacagaggagagaccctcttcataggcacacatggctatgtacacattcatgagtgactgtgcacccacgattccctggcgtacccatacacacatggctgtgccctgagattgcctttctttctttctttctttttttttgagttgggtccatttttattgtggatcggggcttagagcataagcactggtcagcatcattagctgcaccatctaccatccttctctgtgacccatctctataggagcgtctaaatttagcccaagaaatcaggatcaagaagggggaaaaaaaaccattggccacatggccactcctgctatatctacacctaccagtcactgaacacttacccaaggtgacggtttccatgcaggagacccaagcggctctgctagggacaataacttatttgcctaaagcttttttctttctcaaaagagggggcagagaaggctgatttctagaagtagatgtggaattgaagaatgtcccagggagctaagttttaaggactagccacaaacttgttgcttctccaacaatgtcatgaatccattccttgcaccatcgcacgtttttcatgcattcaaaagtgtctctagagctccagaaccatgagtacctcatcacgtcctgagcgtcacatcccccagcaagctgcctgcaccaggcctttctctagaagtcctgagactgagtactctccgaaggctggaggtttgtgcgagtttgtacgtgtggttgagcgcttgtgtgaggaaagtcccgctggggttgatctccatcaaggtcaagttatccggcttggcatgtgcctcctgttgcctcacaaagctgtcagcagacactcggagtttggctatacgagtgtcccatatatccttgaccagggtccggatttcgtctgccttcgggatgttgtctgaagcatgatttaatgggagcttggtaagttccatgtagtaaaggctggtgggcattgaggtaaaaaagtttcttcctttcattcatgatccctcatcttctccaacttttctatgttcatccactccggagggagcagtcgacatttctgcttttgtttcaggttaattgccagccacgggggtacttccactggtaaaccagggttaaaaggccccaggtacccaccccaatgaggtagctcttgtccagactgaagttggggataatggtaaccagctccttctcagccaggaactcgacctcggccacgtccatggcggcgcgagtggccagctcgggcctcacagtctccttgggcccttcagtgtcccggaggaggtgccgcagccactgttttccccgagattgcctttcaatctctgctctaagaggtccaatttctatcctttattgattcctgactcagaaccggatgtgtctctttatctgggggttggagatagggtggaacatggagcgtgcacacagccagtggcgtgtgcacctggcacctgggaatggtgtgagtggcagagagtgggctcaccgcacctctggcagagctgctggggttgtgcgatagcgtgctgtccctgtcagctatcactgtgtgacaaatgatccccaaacccagcagcaatcatttccctaagcgacgattgtgtactcccgctcctgtgtctgaaggtggctggggattagttgctctaccctaggctctgctgggcagctccatttctagccatgggtctggctgaacttactcctccctgcttactgggctgtggtctgtgccataggtgttcattctgggacccaggcggcagctgtccagggacggctcttctcatggtgttgatagcggtgtgagagggccaccccaccacccaggcacattgcatacctgggcttgcccagagccaaaggcacatggcatcccacacagccactccctgatggtggctagctctctcacccacctctctccctcctttcccttcaccccaagcttctcaccttcccccagattccctgctcagcaaagtaaagcttggcactgcccaacagcggctgttgctcttccagccttccccactggggacaatctcaattcattgctccacaacatatcattacccaacaacaattatgggacaagagatacgttcaaaagagtccaggaactctgtggctcaggtgatagggataagagctcagctgatcagaggcagagctggggctacatctgggctggtggtattccctcaccaaccacaggctgcatccagccagtgaaagaaaagaaaacattcacaattgaggaaagaccgttgtacaagcggcttattacacagtggttgagaacatggactacagagccagacttcctggggccaaatgcagttctgccatttactagtcaggtaaccttgcagaagtcactttatcgctgtgcctctgtttgaccatctgtgaaatgggatgataagaagttgtgaagagtaaatgaattaatccatgctaagcagtgtttctcagccagaatgatggtgttccccagggaacatttggcaaggtctggagaccttgtcattgttaaaactgagagggatgctttggcgtctagtgggtagagggcagggatgctgctaacttactacagtgcacaggacagccctccttcacagcaaagaatcatcctcctgacatgctgttagtactgagcttgaggaactttatttatttatttatttatttattttgagacggagtctcacgctgttgcccaggctggagtgcagtggcacagtctcggctcactgcaacctccacttcctagattcggtggaactgaaggctgcccccaaagccctattcaccacttttgggggaagcccttggctgggttgctgaagccaggccacgctccctgccccagcaggtccaggctgagctgacctggtttggctgctggagaggaggctcagccacacctccaccgactcatcccgatggcccgcattcttgctccctcggtcatgctggctttcggcttccctgaacaggctctcggcttcgctgagcaggctcttgcttctgtggctctcagctttacatgggtttctgcagccctgcccttgggaaaggcctttgctccactgtcatattattctcactgcctgctatgacctcacgggcaagggtctcgctaagatcaccttgcaaagcccccttctctacccctgtcttcccattttatggacttggaagctgaggtccatcgagaaaaagggacgtgcccacagctgcacagaacatgagcaggggagcttggatgggagccgaggacttctaggacctgcctcatctttcaggccacctagggggaaagttcatgtgtgtggagagaagggctttgcattcaggaaggctctaagcctctgtgagggctccggccctctgactcactgcaggaatatatttcttcatgctctgtgcttgtaagcccctgcccactctgcaggacaggaactagaggccactcactggctgggcagtcttgggtgagccacttgctgtgtctgaatctcagataggaagagtccagaagcaacatatattgatcaaactaacattgactgaggacttcctattctaagcaccttaggtgtattagcttcctagtaactggccatagtaagggctcgataaacatttgctgaatgagtgaattggctcttacactacactgccccaggtagtctctgttagcttcatattaaaatgaggaagctaaggtccagccaggtttggggactccccaaggtgacgttgctaataaacaacaaatctaggattcaaattcagacccagttgacactagagccaaatttcttgactttttttttttttttctgagacggagtctcacattgtcacctgggctggagtgcagtggtgcgatcttggttcactgtaatctctgcctcccaggttcaagtgattctcctgcctcagcctcctgagtagctgggattccaggcgcccgccaccacgcccattaattttttgtattttttacaaaatacaaaagagacggggttcaccatgttggccaggctgttcttgaactcctgaccttgtgattcacccacctcagcctcccaaagtgctgggattacaggtgtgagccaccgcacccagcccaaagttcttgacttctaaatttacaaatctgtttatctattgcttagtggcacataacaaccatcattttattccgcttagcgattcgatgggtaaggaattgggacagagcgggcaagaatacctgctctctgctccatgatgtctggggtatcacctgggaagactgaatggctgcgggtgacttcatgctggggactggagccatctgtctggaagtttctccactcatgtgtctgacacctacactcaaatgattcaagggtgaggttcggctagggctgttgactggggcacctgcatgtcacctggcacttggcctgagcttctcaacatagcaaccccttccaaggagcaagcagagagtgagagagccaggtgggatcagcttggtcactatgaccagacagagaagtctcatcgctcgacctctgctgtgtcctcttagctgaagctgtcacagcctgacagattcaaggggaggagacataggccccacctccccatgggaggactgtaaaagaattttgggaccatacgtgatatccaccacaactactgtattctaggcagtgttctaggcactggggagacagcagggaatagagaagccaagaaagaaatagttccagcagaaatgaatgtgttatggagaagcagatggcagagacgtaatccaggttagggatgagaaaggttgtatttgaggaagtgactttaagtctgagacaggacattccaggcagagggaagaaggaggtacgtgagacgaggctagaagcatgggcaggtcagtccaatgccttcgtaaggcatttggattttatcctcagggtcctgggataccatgaggattcctagatgcggtgaaaggccagtattgtgagcttggaagatctttctgaaccagagaagggtatctagacgaaacatgggaagactgcgatgaggctgtggtccaggcgagaagtgatggtggcttggaccagagtggtggttcagaagttggtggatagaaatgttgtatgaaaggtaacattcattaggggttcatgggatgtggagacaccaaaaagggtgtgaggagtggctctcagagtgcttgatggaaccatctgatgagacagggaactctgagaggggcacagtgtctacagtggggaaggaaaaatgcattcagattacttcatttacacctggggcctccctaaatcatctagtatggcagttaagtgccctggtagtggggctttcaacctgggttcgtatccgggctttgtcacttgccaatgggacaagtcttggtgggtcccccaatcccgttgggtctgtttccttgtctgtaagttggaaacaatagcacccctacatggcactgatgtattaaactgaggtttggccaggcttgatggcttacatgtggaatctcagcactttgggaggatcactggagtcaaggcatttaagggcagcctgagcagcatagcaagacctcgtctctactgaaatgaaaaattaactgggcatggtggcatgtgcctataattctagctacttggggggctgaggtgggagcatcgcttgagcccaagacttcgaggcagcagtgagctatgatcgcgccattgccttcgagacagagcaagaccctttccaaataaaaagaaataaactgatgcttgaacatgtttgcccctgggcatgtagtaggtattcagtaaaggtttgaaaaccaaattacaactggaggccacgctgtatacttagcacctgagtacttttctgcatgcgctatacctcaacaaagcgctggaaacaaaacaaacaaaacatcagctatatttgtgaggttctgaacaccttttgtggatgcgttctcttcctatcgttctcttcctagaagggggtactcaccgccatgctgcaaaatgtgatgttggaacaatgacacctttagcactgcgggtgtttcattttgtttctgttctttcccctctctgacctcctcagaatgttcttccaaagaaataattgctgccccctcactgcttagctatcaaatggtgatagtgttgacaattttgcttgggtttagtcgctgcagttttcaaattgtcacgaaaacacacagatgctggtaatttcaaagcgaatcgcaaagcaaccaaagaaacggagctgtgcccccagcatggggtgccaaacagattcgcaggaggcactgactggcagttttcttgaaaagcataaatagagcagaacagccaattttataattaactgggacttggtctccagtgaagcttctgctctgtgcaaatgccggagccgttgccaggaggttgtgccctgtcccttccttcaggctctggccgactggaggtttctttgctttaccacattttgagtctgtttcaggatggaattgtttaggactcggagttgagctctgtgtgggcaggacgcttgagaggaagccacaagccagggtctacggtaaaatcctggcaggaaaggccatgtgcagaaagaacatgggtccctcattcaaacattgttaagaattttgagatggtgacagcagttctctgaacgaagtgtgggctgcttccaaacctgggccctgtgtgactgcacaggtcgcacatccatggagccggccctaggtcctggattacacctccagaaactggggggacaacagtgagtgaggtcataggctgagggcaaaatacaacttcagggactccaggggatgggatcccacaagatgggggctaagcaggcagcaggggtaaaatcagaacaaacaaacatccaataaaatagtccttttttagaggcaatgtgataagagttcacaaaccctttgattcagcaattctacttctaggattctcttctactgtacaaaggaacaaaggtaacagatggtattatttgtgatattgatgaatagaaacaacccaaatctccatcaaaaggaaatggggatatttcaaataaatgcgctgtgtgggggaccttcctgtgagcatccagctcctcagcaaagagctatcaaatgcttagcatgcatgggactcttgtggggctggtggaggacttgagttctgtgtcttggctgacatgagcccaaaacaatgtcccctgagtgaagaagagagtgcctgcctttaggttaaatatgcctggggagaaacatgagatgtctgcacaccaaagtgttagcatggaaaacgtggtcgtagccacaggagaatgattgatattctactttgctcacttctgcattgctgggaatttttacaataactgcatattgattttataagggaaaatatagctaacaaaaatgttttaaggccgggctcaatggctcattcctgtaatcccagtactttaggaggccaaggcaggcggattgcttgagcccaggagttcgagaacagcctgggtaacatggcaaaaaccctgtctctacaaaaaatgcaaaaattagccaggcatggtcatgtgtgcctgtagtcccagctactcaggagtctgaggtgggaggatggcttgagcctgggaggcggaggttgccgtgagtcatatcgcaccactgcactccagcctgggccatagaaccagaccttgcctcaaaaaacaaaaacaaacaaacaaacaaacaaaaacagaaaagcacatatatatatattttttttttaaaaaggcagcatgtggatgacttttcctttttaatccaaatgagtcttgttttttaatagggcagttcaaaccacctatgtttattggttttctttgccttttgttggtttccacatgggagcttaaatatctatagaacttgcagaatatacatttttcccacttgaggaaactggggaaatggatttcttccctctcttctggcaggggtagtttatggtctatttgctggcatgtgtcagggtctaggtgattccagtctagtatttttgccattatgaccaaccctaccatttctcaaggatttgggccagcaacagggacattttgtccctaagctcatctgaagtcctggacttcatttatatggaccaggagacttgcactgtcttaccctgagattctttgattgcatgaagcagaaattcattgagtgtagcttgggaagaagagggggattaaagggaaggatgtgggagtcagggctctaggggtaaaccacatagcctggatcatgaaaggctgcaactgggacctggaaaatcaagcttaggttaccccacatccctccatgcctgcagagggtctcctctctgcttcttttggaagactggccactccagccccacacagcttccagttcacgtgcctgatactgacccctctgcccttggttcaacaccttgagagaatgagattggctcagtgatgtatagcacctctgtgatcaggtacctgctctgttcaaagctggctgggagaggggaggagatgaggtgctcctgtgatacaaacaggagacccagggcttggcagccagactcacaaaggaggaagtgtgagggaaggagacaggagactttctgggtaaaaattcagtgagatccacgagacactgccctgtcatttcctcgcctgtcctggtgtttaatcccctcttgggaatgctgcctttaccgtaggtatgtccaagactgttagccttgaccaagaaggtggaagcaagcagagcagtctggccctgctctgtcccctgcagcattgctggtttccaaggatcccgcaggggtgatgggtcaccagtcaatttgctgagatcaccctgagaaacatgcctaggaagcttgcttagcccccaggggcccaggctgatttctggagagccacaagcctcagcacaacccccatcataagcagagacttgctgacctccctgcaccttccccacttgctacagctctggcccctcctcaggccgaatggatcagcttccccagaagaatctcctgcgactacaccctgctggctctgctggctgttccactggagtggagagctccagcatggatggcttttggatggaggtggaacagatccaacagagagatgagctgagggaagaggacagtggcgggaatgaaggccagcttccagagggtgagagaccctggcgggggcctataggggtggtgggagggcttgattccaggcagagaaatgtcagaggatccagatatgaaccagaacatgacagcattttctctgttgcctggactggtgcagtatcctcttcactgctctccctgcttcacccgtgatccttactgtctgttctccatgccatagtcaagacgatcttttagtaatgtaaattagattatgtccctccttagagtaagtccttcaggaaatattttttgagtgcctattatgtgccaggcactgtttaggcactggggatacaacagtgaacacaaaacagtctcctatatacagacctaatgttctagggaaattctaagccctctgctctaaatcctcaaatatctctccatctatctcagagtaatagacaattatgtgtccctattatctactactatgtaacaaaccacctcaagcttagaagcataatgcagcaataatcaattattatgactattactatacctcactgttggaggggttgagtgggctcagctaggtggttcttgctcagggcctctcatgcagttacaatcaaatggtagctggggctggactcatctcaaaagatttctcatctatgtgcctggtggtggatgtgaccatcagggggcctcatctgggattatcatctggaatacctgcatgaggcctccacatgtggcctgggcttcctcacagcatggcggctgggttccaagcacaagaccaagagagagagctgggtagaagctgtcttgctgcttatgacccagctttagaagaaagacaacattgcttctgctgcattctgttaccctgcatgcagctatgttcaaggggaggggaattagactccaccccttgatggggtgagagtcaaagaatttggggacgtgtaataaagccaccagatcataacttaccaggctttacataattggcttcgtgcctcctctctgcctcttctcctcccaccctgactggctgtcactctacttctgtcctcgggcctccttgctggtccttgaccctaaaagcactttcctgcctcaagtcctttggttctctctgctcccttggcctcaaatgctcttgccccaggcatctgcatggcttgttctctccagtcaggactgggctcaaatgttacctcctcagagaggtcttcaccagcttccctacacaaaatagcacccctgccccatcactctctagcccctgccctactctgttcgttgctgcagcaatgatcactgcctgactttacctagtgcacttcactgtgcatgtgtctgtgacccccactagaatgtaacttccatgaggccagggacatcatcggcccttttcactgctgtgtccacagtgcctagaacagagccaagcacattcccctcctccatccttacttgttcagcagatgagggaatgaaagggctccacatggaacccttcctggtttggcatgtaattcagctgggcttgcccctggttggcaaaacagaccacgtggtgatgcagacctcctaagggcctaatagtctcatgcagtgcctccaagtgtaaatgtaaaaacatccctggttacactagaagtggtttcaggagatgccctgcataggaggtcctccatgtggcctctctggaatcatgatgtggccagcaatctaatttcccacaatacacagggagtggagtcagagtgggtcagagagaagccactttgagcaaccaaataaacacaggagcttttttagactcacagggctgagggatcctgagtggcatggagccaagactggtttttttttttcctttcttttctttttatttatttatttaatttttgaaacggagtttcactctgtcacccagactggggtgcagtggcacaatctcagcccactgcaacctccatctcctgggttcaagcgattctcctgcctcagcctcccaagtagttgggactactggcattcaccaccacacccgtctaattttcgtatttttagtagagatggggtttcgccatgttggccgggctggtcttgaaatcctgatctcaggtgatctgcccaccttggcctcccaaagtgctgggattacaggcatgagccaccatgcctggtcatcttttctttttattcggacaccaacttgaaccagagggattgttaataatttatttttcccatcaatgtctactcatggcaggtgatgttggatgctccatttatggtggggatcttgtttccttttaaaatagatgtgttttagtaaaaaatgtagcccatgattaaggggatatatttggtaaggaattttacagggacaattagatacagataaaaattataaaggtggttggtgaatgcctacatttcaagaaacagtggctcattgaaaggatcctgtacaaacaaaaaaatgtctggcatcatgatagaatcagtacctccaccagccagcacaagtcaggaatggacccacaacattgcaactgccctggaggcatctgttctggttcccaagtgcagggaaagtgttgggggaagacttggattatttgcaaaacccaggctgccataaaagcagttttgtttgagtttttaaaacacttattaccttgttgactaactgggtcaacactgggtacaactgtacaccccaccaatcctctcacacatgtgttcaatttccagtaagagctcttgtccatttcccccatgataaggccagtgtttctcaagtgtggtctgaagaccctattgcattagaataatctgaggaagacattcgaagtgcagattctcaggcccgaggcctgaactcctggaacagaatccctggaggtaagacccgagatcctgaaatctcaacacaccctcccattccagttaatggttttgctatgggactatgagagtttccttaggaagcacagtagaggggacaattccaacacaaataaggtcttgaatatggaggacttcccaaagggacatcaacacccagcaccaacttcccaaggggacaccatgtgaccctgtagtggtctctgccagattttggataagtgggttcattactttggagagaagtgggtccaaaatctgaacatgcagggcccttcacccacctctgttttccagggattgctatgttatgggttgacatccatacactggctaatgctatcagtaccccccaccccgcccccagttctcagaaggctcattagatcttctcccccggagagtctggttggtgttaataggtctcacgatcagatatgcagaaactcctgtgtccaggtgagtgtgtgcttctatgcagaactttggttagcacgagtggctgagtgcagagctgtgtgtgttcatctgggttctacttctgttggcagaaggggaagctgaatcccagtggctgcaggacacaggcctgtcgggcctccttggtggcctgggcttggatggtgatcaccaggagctcctgtccaccctgacacagacccaggtggccgctgtgtgccgccggctggacatctatgctcgctcagtgcgaagacaacacaagacacctgtcagagatgtcagggatgtctttggggtcttcaattcaggggtaagtggcatatgggtcattgcaggccccgtctgactgggatctctgtgctgccgccacagcctgagagatgcagtgatcctgctgaagggctgtgttggtgtgtgtatgtgtgtgttggtgtgtgggtgttggtatgtgtgttggtgtctgtgtgttggtgtgtgtgttggggtgtgtgtgtgttggggtatgtgtgttgggggtgtgtgtgttgtctgtgttgggggtgtgtgtgttggtgtgtgtgttttggggtgtgtgtatgttggtgtgtgcatgttggtgtctgtgtgttggtatgtgtgttggggtatgtgtgtgtgtgttggtgtgtgttggggtatgtgtgttgagtgtgtgtgttgtgtgtgttggggtgtgcgttggtgtgtgtgtgttggtgtgtgtgtgttggggtgtgtgtggggtgtgttggtgtgtgtgggggtgtgttggtgtgtgtgttgtgtgtgtgttggtgtgtgtgtattcagagtgcagtggcttgcacacgtatgtctccctgccttccactatgtccctatgttgcatgtaggtcttcatctcccatgcatgccactgcatatatgcctgttgccactgtgtgtccttgggtgagcctgaaagcctaggttctttctatataattgttattgatgcagggcaggcaagcccctaaattggggattagctctggaagcttttggtttcactcaggaaagaattcaagagtgagctggtggtagaagaaaacaacactatggaggcagcagtaatacagtggcgtgactgctgctgcagagcggggccacccgataggccgtgtccaggacagcagcccaggggcaggaccaccctataggctgtgtgtccagagcaacagctcaggagcagttctgccttttaattacatgcaaattaaggggtgagttattcagaaatgtctagaaaaggggcagtaatttccaggtgttgccatggcaatggtaaactgtcatggcactgtgggcatgtcttatggagaggtgtttttgcctcttccttgtttcagccaaagtcccacctcctacctcattatcagtacaaaatcctttttttttttttgagactgagcctcgctctgtcgcccaggctagagtgcagtggcgacatctcgactcactgcaagctccgcctcccgggttcacgccgttctcctgcctcagcctgccgagtagctgggactacaggcgcccgccaccatgcccggctaattttttgtatttttagtagagacggggtttcactgtgttagccaggatggtctctatctcctgacctggtgatccaccagcctcggcctcccaaagtgctgggattacaggcgtgagccaccacgcccggctggcacaaaatacttttttattgtcactgtgtatcctgctgacacttgaagcctgataggttgtgggcatcatctttcttggagcacctctgaagtggcatagcagtgattaaaaccacaggctttggagccagccagacttgggccccagtgcccattccccgacttagcagctgtgggactttgggcaagtaactcagcctctctgggcttcagtggctccatctgtgaaaaggggttgtgggtggcttctgtctcccagggttgtgtgagcattgtcagcttcccacatgagtaattgggcactgtctgtaatttgcatagaaaatgtcgtcagagaatggcgactccggtatgaagggggcccagctcagttccggggcctctaagtttcctccaggtaagtggtcttcattctccagggccctgagaatcctccaggctgcataaagggctgctctgtgaagtaagagaatgtgcacacctcccagcatttcctgcttcctgctgactccctgccttccctgctcaagggcagtagggaggagccctgaggggacaggttgggcccttaagtgagctgttgccatcaggcccatggggctcaagatgggaaaattctcttcctgggcaattggccttagctgggaaatcacttcctggggcagtgagggtcttagctaggaaatcatttcctgggggcaatgggccatagctaggaaatcacttcctgggcaatgagcctgagccctaaacctaatgatttgatcctggggctttgaacttgagcttgggagctcacttcttaggactaagggcctaagtcccgaacccaagcacttgcttcctggcagccagttctcactgcctttctctgctttgtttcccccgccccgcagcagcagagcctggggggctgcaggagcaggctgggagggaagaagccttcaacatggactctgcctactcagaacaagctgcggtgctcctgcagaggagcaggccatcccggggaggcacctctgcctggggcaagtgttccctgccggtgaggatgctgtccacagggctggttggctaggtccccctgtgctcaggcaccagcacccatctcttcacaccttccacactgacaggcatccagcacaaaagttgttaattcattcattcatttaattcgtaccacaaatatttactgagtgaccgctgggtatcaagactggggagcaggatgcttacagtctaacagtcctgtcagtattgtctccatgctctttgtttttatccttagaaagccctccctcctccagcaagctcataactgtccatcaacatgtttttctagttacttttaaaattaattttagtgcctggagtgacagagagagacccaatattttagttctgttctttcctccctctctccctccctcccttccctcctcctcctccttcttttttctttctttctttctttctttttctttctttctttctttgtttttcttttctttctctttctttcctttctttctcctccctccttccctccctccctcccttccttccttccttctttccttccttccttttcttcttcctttctttccttctttccttcttttttttttctttgagacaaggtctcactctgtcacccaggcgggagtgcagtggtaccatcccagctcactgcagcctcaacctcccaggctcaagctatccttacacctcagtctctcaagtagctaggactacagttgcatgccaccatgcccagctaatttttaaaattttttttagagttaggttcttcctacattgcccaggctggtctcaaactcctgggctcaagcaatcctccagcctcagcctcccaaagtgctgggattacaggtgtgagccactgcacctggccgttcttttttcccaaaatattcagttatcccagcatagttccttccaaataggatgtaatcattgatagttaggtttttaaagattgaactataactcgctgttaagtgcacagatatttaccaggtacagcttggtgtgtatgcccgtgtaaataccaacaaatgagtacagaaacttcctcccttgcttgatggcttgtaatatggaaaaagaaagaaagaaagaaacttcctaccccaccaccccctcagtgcccgcatgcccttcccaggtaattcctttccctgcagaataaccactattctgacttctctcatggagtaaatatagtctttcacagtccctctattactaaaggaagtgtttcttctttgaccacgtgatgatgcagtcgatgcaatcttaggtaacattttactgagggctgccctggcccagggcattgttcccaaggcttccagtgccctcattgctccctgactatatgatagaaagaaagagaagtaggatcgggcacagtggctcacgcctgtaatcccagcaatttgggaggccaaggcgagaggattgcttgagtctaggagtttgaaaccagcctgggcaacataacaataccccatctctacaaaaaatttttgaaatagccaggtgtgatggtgcaggcctgtagtcttagccacttgggaggctgaggcaggaggatcacttgtacctggaggttgaagctgcagtgagctatgattgcaccactgctctccagcctgggccacagagcaagacctaaaaaaaaaaaaaaaaaaaaagagaagtggcatatgttagtctgtttttacactgctgataaaggcatgaaagaggtttaatggacttacagttccacatggctggggaggcctcacaatcatggtggaaggtgaaaggcacgtctcatgtggcagcagacaagagaagagagcttgtgcagggaatctcccctttttaaaaccatcagatctcgtgagacttattcactatcacaagaacagcctgggaaagacctgcccccgtgattcaattacctcccacagggcccctcccacaacacatggaaattcaagatgagatttggcgggggacatagccaaaccatatcatggtgctcagagaggagaagtgacagaattggctcccacaaaggccaggacaggaacacctggcagcctgaccctggagccttcccaactgaccaccactctctactgcttaggaaaccaaccccaccccctgcagtagcctctattccaatgtgagagtactttcactcattcaaatggaattttcttaggtccacagcaagttgcaaaaacagaactcccacgtactctgcacctagtttctcttagtgataatattttccattaatcatagtacatcaaataacatttatatttatttatttatttatttaattttttcttttttgaaacagtctcactctgttgcccaggctggagtgcagtggcaaaacctcggctcactacaacctccacccccgacgttcaagtgattgttgtgcctctgcctcccaagtagctgggactacaggcatgtgctaccacacccagctaatttttgtatttttagtagagacagggtttctccatgttggccaggctggtctcgaactcctgacctcaggtgatctgcccgcctcagcctcccaaagtgttaggattacaggtatgagccactgcacccggcctaaatttttttttttttgagacggagtctcgctctattgcccaggctggagtgcagtggtgcaatcttggttcactgcaagctccgccccctgggttcatgccattctcctgcctcagcccccgagtagctgggactacaggcgcccgccaccatgcctggctaattttttgtatatttagtagagatggggtttcaccgtgttagccaggatggtctcaatctcctgacttcgtgatccgccagcctcggcctcccaaagtgctgggattacaggcgtgagccaccgcgcctggcctaaaattttttaataatgagtttctatttctaaaacatcagagataattaatattcaacattatcttgtctttttctttgacagtgtttctccattaaattatgaatgatgataataattaatcacgctaaagggccaggcatggtggcgcacacctgtaatgccagcactttggaaggccaaggtgggaggatcacttgaggccagaaattcgagaccagcctgggcaacatagcaagaccccatctctacaaaaattttttttaaataattgggtgtgggccaggcatggtggctcatgcctgtaatcccagcactttgggaggccgaggcaggcagatcacttgaggtcaggagtttgcgaccagctgggccaacatggtgaaaccccatccctactaaaaatacaaaagttagctgggtgtggtggtacacaactataatcccagctacttgggaggctgaggcaggagaattgcttgaacctgggagacagagattgtagtgagcagagatcacgccactgcactccagcctgtgtggcagagtgagactccgtctcaaaaaaaaaaaaaatagttggatgtggtggtgtgtgcccgtaatcttagctactcaggaggctggggcaggaggatcacttgagccgagttcaaggttacagtgagctgtgattgtgcccctgcactgcaacctgggtgacagagcaagactctcctctgaataataataataatgctaaagacatcacatattgatcttttaccacacactaagcattatgccaagtacttcacatatttgatttaatttcattctattaagttagtgataactgtgttaataaactaaaaagtagtagtaagtattgagtactcactatgtgtcgggcaccatgtttcatacactttattgaatttaatcccaccaacagtcttgtgaagtagatactgttatcacttccactttgcagatgaacacacaggtaaaattatttgcgtgcactcacaggtaaagtcaggatttgaaccccgggggatgtgactccatagcccatgccgcaagcactaggctgtattataagcatcaattactatttctttccctttgagcactcgaaaggggcactgggaagtggtccagccacgccctccaggcagtgctgagcaagcctggccctcccgcttgccttctctgaccttgggcggcaggaaagcctggagctgcctgcagattcccaaggtggcctctagatggcacggttgagcattctttatttctgccggtggcatggccaaggctggggacagagccggtgaggcagaggaacaaaggaccagagtagaagcaataataagaagcccatggggtgatccctcttctccaggtcctcttgtggaagggcaggcagtgaaaacagtttctgtttcttggggcttcgctatgtgcttgggactgtaccaagcactctatatccattaggtcatttgctcccgctaaaattttatgaggtcgttgccgtggctcatgcttgtaattccagcactttgggaggctgaggtgggagaattgcttgagcccaggtgtctgagaccagcctgggcaacatagagaaaccctgtctctacaaaacatacaaagattagccaggtgtcgaggtgcacacctgtagtcccagctactcaggaggctgaggcaggaggatcagttgagcccaggaggtcggggctgcagtcagcagtgttcatgccactgtacgccagcttgggcaacagagcaagaccgtgtttccaaagaaaaaaacaaacaaacgtgcaaaaaccttctgaggtaggctctattttatgattatggatggagaatcagagcctcagaatgtcactccgtttgcaagaggtggagcttggacttgacttgaggatggactcctcttgagtgcttgctcttatccacgctgctcttccttctgcctaaatgccctggggagaagggggagccccaaaatacacatcagactcatagcctgacaaattgtctttacttccctctctattaatagaagtttaccgtccccaaaggcagacttggcgtgacgaggataggagacttgtccctgcaggatatgaggaaggtaccttctctggccctcatagagctgaccgcgctctgtgacatcctcggcttggacctgaagaggagcaaggcggggaagtggaaagcggcaggtgagcagccccagcccagggaaagccctgtggccacagtcctcatagggagctgaacacggactctcccagcaagagatgctcagctttgtctttctttcttttttttttttttgagacggagtctcgctctgtcaccaggctggagtgcagtgatgtgatctcggctcactgcaacctccgcctcccgggttcaagcaattcttttgcctcagccacccgagtagctgagactacaggtgcgcaccaccatgcccagctaatttttgtatttttagtacagacggggtttcaccatgttggccaggatggtcttggtctcttgacctcgtgatctgcctgcctcagcctcccaaagtgctgggattacaggtgtgagccaccacgcctggccagcatgctcagcttctatattccttctgtttacatttttttttctgcatatgtaaacaattcctgctcattgtgggaaatttgtgaaatagagtaaaatacaaaaaggaaaaaatataattcagaaaagcacttttagtgtattatcttcctttgtgtgtatatgtgtgtatccttttttcacctaatattatataattatggtttgggagcagtggctcacacctgtaatgccaacaatttgggaggccgaggtgggaggctcacttgagcctgggagtttgagaccagcatgggtgacatagtgagaccctgtctctacaaaaaataaaaaagtagccaggcgtgctggtgcacacctctagtcccacctacctgggaggctgaagtgggaggatcacttgagcccgggaggtgaaggctgcagtgagccttgatcatgccactgcactccagcctgggtgacagagacagactctgtctcattctatatatatagaactatgagaccctgtttcataattccattatatataatagaatatattatagttatagatctatattatagaacattatatataatagaattatggacattttccagttattgtatcatttagtggttgtcatgataatgctacataacaaacaacccccaaactcatgacttaagaattctttactcttgctcacatgtttatgagtaaactgggcgtagcttggctgatctaggcttagctccaagttgttggctgagtgtaggtctgctcacaggtctctcatcctcctgggaccagctggctgtctggaggatgttcttatggtgacagcagaagctcagagggcaaactgtaccgcattttaagcctctgcttgcatcttgtaggttaccatgccattggtccaaactagtcacatggcctagcaaggggtgaggaagtacgctgtgcttccctaatgggaagatttgcaaattcacatggcagagggtgtggatacaaagaggggtaatgaatttagaacaatagtgacatttaccacaactattaaatattccttgaaaacatgatttttatttatttatttttttttttttttgagagaaagtctctctctcttgcccaggctggagtgcagtggcatgatcacagctcactgcagcctcaatctccccaggctcaggtgaccctctcacctcagccgcctgagtagcttggactgcaggtatgtgccatcatgccctgctaatttttgtattttttgtagagatgcagtatttttatgttgcccagaccggtctcgaactcctgggctcaaatgatcttcccacctcagcctcccaaagtgctggggttacaggcatgagtcaccttgcctggtgaaaacatgatttttaatcactgcactattttcctcctcgtggatgtattctaatatatttaaccatttccctattagtggacatttttgatgcccatgtctttcctattataagacacaatcattactgctgtatatatgcttttgaatgcatcttagcttactttagattatacttatgagttaagttcctgagataatattgcccttcagcagtgtatgaaagtgttcatttcactgcagcattgtcaacattatgcattgtgattttttggtttgttttggtttggttttttggtttgtttctttaaagacaagaggatggtgaataaaaaaagaccagggggaggaatctagcagaggtggggtaggccagagaagggagaaagaaggaaggtgtggagaaaatgtggaaggaggagtttgcctgagaagacctcaagccagggtggttaagattgacccagggaatacattctctaggacctggcccatcctgcagagccagagctctatccaggactgctgttacatttttatacctggtgccttctggagcagcagcgtgcttccctttcaatacttttttttttttttctgtgagacagaactttgctcttgtcacccaggctggagtgccatggtgcaatcttggctcactgcaacctctgcctcctggattcaagcgattctcctgcctcagcctcccgagtagctggggttacagacacccgctaccacactcagctaattttttgtgtgtttttagtagagacagggtttcgccatgttggccaggctagtctcgacctcctgacctcaggtgatccgcctgtctcagcctcccaaagtgctgggattacaggcttgagccactgcacccggccctttcaatacttctttaaccagctaagattttctgctctgagacatatctcctcagcagtaatgttttaatgaaaacattactgctgaggcctaatgttctgctcaagaggagcggtttgggtccaaccattctctagagagctcagtccttccacaggaaaaggggtctgattctagttgcccaggagatcctgtaggtcggagcccagtgatcattccaagaagtgaaatgtgcctctgctctttgactttctgcagaaactcgcctctttggtgtgccccttgacagcctgctagaagctgaccacaaagtcctccccagcacacaggtcccgctggtccttcaagccgtaagtcgcccctaccccagcttgggtttatttaatccttcagaggctggctcaggggaccattgtcaggagacatccagcaaaggggtgaaaggatgtgctttagaatcaggcagacttgggttcaaattctggctctggcacttgctggctcagagacctggggtggatttttgctgttgttgttgttgttgatgttgttgtttttattttataaatttttgtcttggctgggcgccgtggctcacacctgtaatcccagcactttgggaggccgaagcgggtggatcatgaggtcaggatatcaagaccatcctggttaacacggtgaaaccccatctctactaaaaatacaaaaaaaaaaaattagccgggtgtagtggcgggcacctgtagtcccagctacttgggaggctgaggcaggagaacggtgtgaacccaggaggcggagcttgcagtgagccgagatcgcgccactgcaccccagcatgggcaacagagagagactctctcaaaaaatacataagtaaataaataaataagtaaatttttgtcttaattttttttgtagagacagggtctcactatgttgcccaagctggtctcgaactcctggcctcaagtgatccttggggtggattttcttttcttttctttttaacttctgaatcttaaagtcaagggtagatttttgaactttcattagcctccctttcaacatctgtaaattgggatgatgataacagtatcctcctcttatcaatgattaaatgagaaaaatgtgtatgaagctctcagaatgctgggctcatggaagtggtcacaaaaactaatattattccgaaggaaacccttctcctggtactcccctctttctgattttcatgggagacaaacacaccattttgaatcctgcttttcagcggttcctggtttaaatgctggtttctctttctgacagctgctgtcctgtttggaaaagagaggactggacatggaaggcattctcagggtgcccggatcccaggccagggtcaaggtaatggtttggcttcctggcttcactgaggctgcatctcccccatgctcacatgtgtgttaagccgggagggaaaccagtccctgactcgccagtgatctgtctttggtctctgtgtgggtcgagggtttgagaggctgaaggtggcatgatgagcatggtggcagagagtgtgggccctggagtcaggccaccaacgtttaatgagcagagctctgtgctcagtgacacgcacgttagaccatttcgtccttacttcaaccccacgagggaggtgctcttgttgtccccactttgcagatgaggaaaccaagccccagagaagtggtagagcgacttctaccagagccctgggccaactgtgttttcatgccccgccttcctgtaggggctggaacagaaactggagagagacttctatgctggcctttttagctgggacgaggttcatcacaatgacgcctctgatttgctcaaaaggttcatccggaagctgccgacacctttgctcacggctgagtacctcccggccttcgccgtggtgcctagtgagtgtgcccaagcccttagcctgtgcagggatggagagttggctcactggccttggtggagaggggaagccatgcaaaggcaggactccgtgttcctggaaatgtctgttccagaaatgtccaactgatgggggaagaagcaagtgtgaacatgtgagcccaatgtgtgcacatacacatgtgcacgcgtgtcctgcgtgtgttgtatggcatgtgtgcaggtgtgtgaggagaggaggctaaggttttgcacactacagtccctattagttctcacatggatgagtggactagtttccttcacatcttgacatccatggggttgagcttatcagcatcattacctgtgtatctgtgggcacacatgtgtgtgcatgtccatctgtgtgcacatctgcagatcagcatgtgttgcacggaccttgctgtatgtatagtctgcatatatatgttcctgtctggacttcttcacaatccacaatgaacaaagatagtcacttctatttttctcaaaaaaatacagcagctctcctgagatctcactcacaaccgtgaggttctccctgtctctctgaattctccaaaaagctccaaggctcaggcagtctgatttctacccccaagctagggacagggatcctgagaggtcctctctgacctttgattctcacgaccgcagcgttttggttgttgttgttgttcttcttcttcttcctcctcttcttcctcttcttcctcttctttcttcttctttcttcttcctcttctttcttctttcttcttctttcttcttttcttcttttcttctttcttctttcttctttctttctttttttttttttttagagatggggtcttgctctgtcacccaggctggagtgcagtggcatgatcctagctcactgcagccttgaactcttgggttcaagtgattctcctgcctcagcctcccaagtagctaagaatataggcacatgagaccacgcctggcatacttgtttaacatttttttgtagtgacgggggtctcgctatgtcgcccaggctagtgtcaaactcctggcctcaagcgatcctcccactttggcctcccaaagtgatgaggttacaggcatgaaccatcaggcttggcctcaacctcattgcaaaacataaatcagattccttccctatgctgttgcccaccctccacagcactcttgtaataagattccacttcttactaggcccacctcctccggctcaggtcctgcctatttctggccccctttcctcctgggcccctccttccccactgtctggccaggctctctcgctttgctgttccccctcctctttccttccctggggcctctgcacttgctgctgtgtctgaatggaacctccctccaccctcatttggctgctttctgccattcaagttccagctggctgtcattgcctgcgaggggccttccgtgaccccacacatcatgctgcctgccagcctctataatgatgcaatgatgcccatcatactctgatttattctttgcttgtgtattatgtctcctctctgaaatgtaagctccatgagcctgtgactttgttttcctcctttactattgtgtccaagattcctagactgagcacagcacctgacaggtacttgatagatatttgttgataagtgagagaaggaaagaagggaaggagggagggagggagggaggaaggaaggaaggtaggtaggtaggtcatatggggtcgcaggcctggcgcccagggtgctcagcctctgtctcctacgcagctcttctccaggttccagccagctctcagctgctgggtcttgtctggctctgatgaactccttctttgaatctataactactacctcctcctacctacctcctctccccggagatcctgacaccaggtgtgagacagcttttccttttcaaccctcacaacacagagggtttcatgaaaaccttctatctgggcccattgagctctctgtctcccttcctaagggtgatttgctggttcattgcatttctgaccctgggctgcagcctggactgcatctaggtctgtgcggcatgtgcttgcctgcacatgcatgcgtgtgtttattttgttacacaaagtatagcgagtgaacctcccacgagcactggtcagggctctgtctgagccaacattagacaaggaaatagtcccacaccttatgaaaaaagggattcctggctgtcccctggctttccagctctggaatttccccaagaagagaccagactgagggagggagtccctgagcctcccatggagactgaggtccctcccttcccgcagacatccccaacctgaagcagcgcctgcaggttcttcacctgctcatcctcatcctcccagaacccaacagaaatgccttaaaggtaagagttaccatgcaccaccaccactctgccatctcagcccacagccacagccatggcttcaaatgtgctcattcattcattcattcattcaacaactctgccaggtgctagggttcagtgatgacccacacaaacctctcttgagactttttcttaaagaaagtagatgagtcctgaaaggggatagtcccggagtgggcactgcagagcgtcagttccacgtggtgctaacaggtgttagcaccttgtggccaagcatggatgggtaaacacagagttcatgaaacaaggttaagaatacttttctccccaggacttctcaaagcctttggtatattgaggctttagagaatctccaagtgggattagagtatgcagcactctccaaactcagttgatcacagacctcttttgttgtggaaagcattgcatggcactggtgttccatgcagaaccagtttgggaaacagacccttagcaaattctccttgtcgtatgggaatggatgcagggccttggcccagctccctgtaccgtcttgactgtccttcagtcagactcaagatgtgcctccaggatcagcctgaggaggccccgggtcttcctgtttgagtttctgcttccttttcagtaaactgaggatgataatagcattaatagcatcttgtctaattgttttggaaatcataaaagctaactcatgaggaatcatggggtagaagatgatgctttgcagggtactcaatatgtgtcctcttttcctatcctctctccctccctctctcccttcctttcttcctccctccctccctccttccctcccacctcccttccatttattcttccttccaccacccatttattctcattcgtccatctattaatcttttctttctccattcatccatccatccatccttccatccatccatccctccctcccttcttcactccgtccctttgtccttactggctatatgactcttggcacattctccaagcttgtttccttatctgtaaaacacatgcaataataagagctaccttggccaggcacagtggctcattcctgtaatccctgcactttgggaggccaagacgggaggatcacttgaagtcaggagttcgagatcagcctggccaatatggtgaaaccccgtctgtactacaaataaaaaaattagctgggtgtgatggtgcacacttgtaatcccagctacttgggaggctgaggtgggagggtcacttgaacctgggaggcagaggttgcagtgagctgagccaagatcacaccactgcattccagcctgggagacagagtgagactctgactcaaaaaaaaaaaaacaaaaaacaaacaaaaaaaacctaccttataaagtttctgtgaggattaaatgagatgtaccaattaaaggcccaggaacacaaagaatacatagtaagtggtagctctcatcactttctgctgctcttctcagtgtctctgcttctcccagcatctctgcttctctattccttcctttgcattttgggtagacccagactccagaaagaaggagctatcctgggcctcaccaggaaatgacccatgttccagacctgtggcccttttctacctggaagttgaagtctgacccagttgtctcattagtctctgagggagcaggggagggaaagagtcttggacacactgcagagcaggaaacggagacacagagaggtcatggagtgggccggtgacacagctggaacgggagcccctcttgctgccctcccagctcctggctccttcctagcacccccttatcattcatcagaatgccctggggatggtggggaggcgccagggatgggctgagatttgagggaggctctgcacccttccctaggcactgctggaattcctcaggaaggtggtggcccgggaacagcacaacaagatgactctgaggaatgtttccaccgtgatggcccctaacctctttctgcaccaagggcggccccccaagctccccaaaggcaaggagaagcagctggcagaaggggcagccgaggtggtgcagataatggtgcactaccaggatctgctgtggacggtgagtgctgctgggcgctgggtatccctctgggtgcagctgccgtgccgcccctgctctccaggagcctgggcattgtcctttcagttccctagtgtgtcccttccaggacctttgttggcctctgcacaggcctgtgttttcttcctccccctgccttagtaaccaagaagaagtgtcttcactttctgtctccactgccatgcctctcagtcagtctgctgccatctggtctaccccagattgcaggagttcccccaactcctgcaaataattccttcacatcaaagcttttatgctgctgagaaagccccatccctgaggcccaggatcacagggcctgcctaagacagagcccagaaccagataacagggatacccctgccctcctgcccccaccgtgagctttgccctgagtaacaagtgacagcaaggggaggagccagagcaggagagaggcccctctgcggtgtcagcatgcatggtgcccctagcactgagacccctccagctcttgagactcctgtgaacacaaggcagcaccatctaccactgctgaccaggctgctttctcacctagcgatgcgtagcctcttccctccatctgttcattcatccttccattcagtctcccatccatccacccactcacccacctacccatccatccatccacccacccatccatttatgcaactgcccgtcacccacccactcacccacccacctatcccccccacccatctacttacccacccatcaatccattaattcctccaactcccccatccacccatatgccaatctatcatccactcacccatccaccaatcatgcatctctccactcatctaccaatccatccatccacccactcattcacccatccactcaaccatgcatctatccaactaaaccacacatctatccaactatctacccatccatccatccactcatctaccaaaccatgcatctatcccactatctacccatccatccacccacagtccttccctctatcccttccttcttccatggtcattaggttagatttcctattccagaaaccagcaagtgaagccctctctgactgttcccacttttcttcctaccctgcctgggcactcgtctgtgttctaaacacagcaaacgccagctggcactccaaactcatctagtacttcacacttctgaatttttgcttatgcagtttactctgcctggaattcccttcccttttttttttttctaagggcagaagcctggtgtcctctgctcattcttcaagacctcctagttcaaaagtcaactcctctgtcgaaagtcccctactcctccctcatacaccccttatacccccatagttcctttcttctctgcactcagccctttgagataatgttgctactgaaagacattggattgtaatacttctttttattggaggatgctttaaaaattcaagaaattcttgaatgttttcttgttagaaaagcttcagaaaacatagatgtagaaaaagtgaaaggggagaacccccatcaccctcgctcttccccgtgtgtgtcacctttagacagcacacacatagcagcaaaaaggggaattcagaatcgactccagtttcgtcagaccctgggagacagaaacatgttattagcagggtccatggagtctgggttctctgactctgctgggttcggatcccacagagaggcatgggttgatctggaggtctctgtaggaatcccccagtgtgggctctctgggggttctcagagcagagcctgctccaggtgtgttttggggacacccctgcctgagtgtgccagtgagcagctatccctcagcaggtgcaggaccctccagcttctgtcgaggggaccactatccactaagcctcagggtgggctccactctcagggtcccctactccaaggtccactttaggggctgaatgccccctcctcattccaccaaaccagtgcttccgtcccgtgtccaacaaatgcatatttccaagccctgtgggacgctgggccagggaagaggccacgatgaccctggagagggctctgcctctcgcccccagaagtcctatccccctgccaaaacttgatcctttctggccaggtcgcctctttcctggtcgcccaggtgcgaaaactgaacgacagtagcagcaggcgcccccagctctgcgacgcaggcctcaagacttggctgcggaggatgcacgcagacagggacaaggcgggggacggcctcgaggcggtgagtgcccccgaccccagacaggtggagaagggccgaggcgacaggagggcacctggggcgcggtgcttcccttcctccaggtccccgctaccgggctgccagcaacggcccagtgaggccaccagggggcgttgcggcgccgtcacggggagcgaggaggcgtggctgcgaaacgagggcttagaagcgggttggggaggggaaatggagtgactcggagacttcccctagaaaccgtcaccgccgccccatttttcggcagcccctggccgagggttgggaaaatgggagtcgctctgcggggtgtgaggtgattggggctgggtgggggatagtagaagggaagagccttccaaaaatactgagtattcctaggaggggtcctgaacacggttccttattaaagtcccgattagagaaattgatgagcgttgaggctgcaccgtgcacgatgtgtgggtgatgggtctttatacaaacctacatgtctgtgtttgtgggtgcgttgcatgtactcctgctgtgtgtacaagtgcaccgacacaggcatagaaacacaaacataggcatagaaacacaaacacacatctggaatgtgtatgtctgtgatctgtgcccaagtgtccggtatgcgtgtgtgtgtatcttgtgattttcagcgtgggcatttgcgtaagtgccatgtatgcgtgtttatgcatccacgttggaactccaggcaagctgactcttatgtatatggatctttctctctctctctctgcagactcccaaggtggcaaagatccaggtggtctggcctatcaaggaccccttgaaggtgcctctcacccccagcaccaaagtggcccacgtcctgaggcagttcacagagcacctcagccctggttccaagggtcaagaagacagtgaggacatggacagcctccttctacagtaagaggcacctcctggaggcaggagcctcttccctgcagggagggctctgcaccccagagctgaaggccaccagggggttacacatactgttggcctgacctggccttccctttctggggtggtcagatgggttctccaatcttagagagtttcttggctccaagtaataatcatgatgaccaccactcactcattcactttaataggtatttaatgaatgcctaccaccaggcaccatgtttttctgttggtttgtttgtttgtttgtttgtttgttttgagatggagtctagctctgtcacccaggctggagtgcagtggctcgatcttggctcactgcaacctccttctcccaggttcaagcgattttcctgcctcagtctcccaagtagctgggattacatgcacctgccaccatgcctggataatttttttgtattttgagtagagacagggttttactatgttagccaggctggtgtcaaactcctgacctcaagtgatctgcccacctcagcctctcaaagcgctgggattacaggcgtgagccaccgcacctggcccaccatgtattaagagaattatagactagccatgaaaagaacagacagaggccctgctcttaagagctcacagtcctgaggaagacctggatataaagcagatagtcacgaatcaaagatcaagttacaaactgtattaggtttcataagaaatgcagggaacaatgtgtctggaagccaaggaagctggtgtcatctgggagcgaggtgaggcttccaggcacagaaaactgcacagtaaaggtcctgcagcaaggagcagagcctggccaaggatctggaagaaggtcgggggctgatgtgcagccatcattcctagggtacaggaaacagcctgagacctcaagagcttccttgttggcattggcacaagggaccctcagactgtcatcttcagcaagtatctgatccagctcctccttgaacagatgggagcactaagactcagaaaagagaagggacttgccttaggccacatggcagaaaagaggccatggaattgaactcaggatacccataattatcatataataattgtgattcttacatgataggcatcattatcatatgtaatcatacaatgtccataatccatcttgactcaaaatcttcccctcacagcaggctcctgtccccatctgtcaccactcattcccttgccttcgcagtctccattctgatgcccagaagaaaggggcctcgcagcggggtgcacccctggctgagcctcaccacgtgccctccagctacctctccccagcccctgggtgctggactctgtcactggctccagctctctcaggagggtccttatgctgcttctccccagcaggaccaaaaatcagtgaggactgccctttccagggctgggggccatgcacagttgttggtcttgatgtttccagaagaaaaaggcagtagttttttttttctctctctctgttttacagccataggtccatggagtcagccaacatcctcctctatgaagttggagggaatatcagtaagttccactgtgggaaacaggaacagagcccgggtccctgggagttcttcgacctcaaaggctcactgggcccttctgtgggaggccagagtaggcctgcagatgagccctcccttcaggtctctgtcttcaatgaaaccaggtggagtcctgctgtaaggttaaaggttagcctgtgcaagtcttaggagcctatcctggagtttggattttgcctagagctggcctcaggcttgcagagagatgcagaagatttgtttagtgtgaaggttcacagtagcaccagtgaaaccgacgcctctgggacaccctagctgggatggacttcatccctggcctaggggccaaggagtccttaaggaattctgcaaacacatatccagctctgggagttccctggctctgtgggaaccaaggatgggccgctgtttccctttgcattctctagagtaatgatcctcagactttaccagaacctcaggatcccctggagggctaagacacagattgcggggcctaagaatgtgtgtttctgatgagttcccaggagttgcagatgctgctggtcggggggccacactttgagggccactggccaagaagcagaagctaagacatgtcttcagtagtacacgatgcattgagggggtgcccctcaggaaaagggttccaagggacagagtgaaggaggatagggaaggggcaggggccaggagtgttcgcatcctggagcttggcctgatccactaggtggctctagagaacaaatcacatcagagttgttgcattctgaggcaagggcactggtcttcagtacatctgtgtccgtcagtcatcgaccgtgggcttcccaggggaaagggggtgtcacttttctggcaaggcatcttccctcagcggagctcagttctccagcaaaagaagtagctgtgagctgtagcagtcaagatgcatacagccaggggacagtgcactgcctggtgaagggctctgtgcaggggaacagcatctcctacagcctcccactcaacctccttcaccccttcttcccacagatgagcatcgcctggacccagatgcctacctcttagatctgtaccgtgccaacccgcatggtgagtgggtccttaaacagaaccccacctaaaccctgcgagtctcaggagcagcctggatgcctcctcctctcccctgctggctctgtgtccatgtacccagcatgagaacaaagctattccaggggagggtctgagttttattccaaggcttccttttctgaaatgcctctcagacccctcagaaatagactcaggggtggtgctctctccactcagaggggatgaggggctagggcctcagggaggggaggccaacactgtagccatgatcagccctggaagaactggacagaggaagaacttcccttcacagctctcatgttttaaccgtgcacacaatgccctcactcccctccaccctccagccctccagagagttgcttcctacaccaagcttgctgtatgacgccaccacttggggcgcttggatctccatgggcttctgtctgtggcttccagactggaggaaaattaaaaatgcagtacctttatcaagaggtagttggggtcttttccccccaggcaaaattgtttcgaaagtggccctacaatgtgtagtagcagcagcaccagagacaaaaccaggagagctctgtgaccttggacaagccccttgccctctcagaatcctttcaggatgaggggctagggcctcagggagaggaagccaagattgtagccatgaccagccccgggagaaatggacagaggaagactttgcttcacagctctcatgctttacatgttgatttgtacaatcttgtcattttgtaatatgatataatatgtaaacgtaattgtttaaacagtaaaggcacaacaagttcaatgtcacatttactttgcctgtttttctctccagtccagtgctcggtaggtgttgtccttccagcgagttgacgtgggagcttggtgacgagagcatcttgctgagctgctcaaagggctctggcccatgtgatccagccacgccttgaacccacaaccaccgggggcgggagggcaggaagagaactcagaatggggaggcatggagtaatgatacccattgctgaagggtgggggcattgcagggacagcctctctgggaatcctctcatctcctacagtcccaggtctcacccttcctcttctcctctgccctgggtctgtatcctcaggccaggtgaggcttcgcttatttgttcacttaacaatgagtttactgagcatttaattatgtgccaagaggttcacaaatttaatcttcacaataatccagtgttttcggtttgggttcccccagaagcaaaatgtgaggcaaagactcaaatgcaaatagtggtcctaagaaatgcaagagagtggggatatgagagaaagagggggaggcagtctataaaagggtgcccaatcacaagcaagctaccactgggggcatctcgagcttaattccactggagaactctgagaaacagtatggaagatgtccttcagagttaccctacccaagggtcaagggagccagtgtgtttattcaactcctgtgagtcattggttgacagctgctcctgaggagtataggtatttgtttcctggtacttccgcctgccagagtgcaggcacagtgtgctccaatactcagagaaagccctcaagaagagatacagatactggcaagtagacattggccactgtacacagatggcaagtgctgaagggatatgggtgggcatcaacagaacctgcttcatcctgtgaggcaatgatggtgagatactgatgctgatggtgatggtgatgctgctgatggtggtgatggtgatgctgctgctgatgatgatggtggggataatgatggtgatgctgccgatggtgatggtggtgatgatgatggtgatgctgctgatggtgttgatggcgatgctgctgatggtgatgatggtggtgattacgatggtgatgctgctgctgctgctggtggtgatcctgctgatggttttgatggttatgatgatggtgatgctgctgacggtgatgatggtgatgatgatgatggtaatgatgatgatggtgagggtaataatggtaatgatggtgatggcgatgatggtgataataacgatgatgctgatggtgatgataatgatggtgatgctactgctgttgccactgatgatggtgatgatgccaagagcttgacaagtttgatcttcacaataatccagtatcttagtttgggcaatgatggtgatgatggcagctgtcactaagcagttactacgcaccaggcattttacagatattaattcctttgattctcacaacaaccctatgtgacacgttattattccctttttataggagaggaaaaaccaaggctcagaaagttaacattacttgtctgcatggctgataagtgacaggttaatctggtgtcaagatgcaagctctactattttagaccataaatatgaactgttttgccataaatacccatatttaaaagtgttttggtaatggtcacttcctcaatgtcccctcttccctccctcatcccacaatacaaataatctcagaatgagagaaggtatttctcttaaaccaaggagacctagtaaggagggattgacatttgtcctggaattcctcaatagagcatttgaagcttgtagctggttaagagcctctgagcggcctcagtttccctagcagccccatctgaagagccaagatgtgatgaagcatgaatttagcctagcattagccccacaatcctatgaggtgagtgttaccatagttccactttacagatgaagaaactgagtttcagacaagttaaaccatggattcaaagtcacacgcagggtgagaaacttggatgcctgattccaaatccagggctttttcagtcacaccatgatttcctgaagcaatatcaagtgcctgataggtgacagcaagaagagtcaagaacagcagtaggaaaattggacaaattatttaagttggggagataccaagggattcagccagagttgctacttctgttcaccaatgtcctctctacctcccatggtctacctacaagccttttggacctccctccaaaatatactccaatccatccacttcactcctttgttcctactaccatcctaatccaaactactaccatctcgatgccttggataatagtgatcatgatggtggtggtggtagtggcgttgatgatggtgatggtaatggtgatgatggtggtggtggtgatggaaatgatgatgttagttgtggtgttgatgatggtaatgataatgattgtgatggtggtgttggtggtgctggtgatgataatgatggtggtggtggtggtggtgatgatggtggtggtggtgatggaaatgatgatgatgttagttgtggtgttgatgatggtaatgataatgattgtgatgatggtggtggtggtggtgatgatggtgatgatgattatgatggtggtgttggtggtgctgctgatgataatcatggtggcagtggtggtgatgatggtggcggtggtggtggtgatgatggtggtggtggtggtgactgatgagaatgatgataatctaaaatagttaagagtttacatcttgacaccagatggtgcaaggccttgatggcctccatgcctcttaactgctctcccttcttgctttcctctctattcatatatagcagctactgtgggcctttaaaaatataaattcaatcttactgaaagccctcctgctgaaaactttccagagggatcccattaaacaaatatcccaactctttaccctggcctatgaagccctatgtctgtgacaccacttcactcatactccctcccaccttactttgcagagccagtcagtcacatgagcctccttccaactcctcagacatcccaagttcattcctgctttgggcttttgcacctgctgttctctctgtccacaacactcttcccccagctacttccatggccagctcctttcgcctttggatctcaggtcagatgtcccttcctttgagaggccatctctgactaccctatctgaagttgcttcttctgtcactctctctggaattgccttggtgaattttcttcctagcatttattactatcctaaattatcttattgagtcagttttttattttctgtctccctgactaggatgtagccccatgaaggcagagactatgtgggcttttctcacttctatggatatgatggatatgatgtggatataatggtactagcagatgctcaataaaaattggctggatgaatgaatgaatgaatgaatgaatggatggatgaatccctctctgtccctttgtttgctctggaagctgttgcccttatcaccttatttaactctcacttccctgggttcatgtatgaaaatgagaaaatgcatctgaagtacttatagcaagtgctcagccagtgctctcattattattattaattattaacaaaggccagacagcctaaaatagtgactaatggtactatcctcttgtgcttcccagcacctgcggtggtccctttgcacacctcattcactcattcccagggtctggatgacaggatgcagtgtggttggagggaaaatcctttacccttggcaggaggtgaggcaggttcctctgtgagtgctgagagcccaggccctgctgtgctaactttgcactcagagtgggctgtcagccaccagcagagggtcccagtttaatcacatgtcagtttctccattcatcttcggtgctatctgagggctcatctttttctactctgtggcatcgtcatgattgatgatcctgcaccagctccaccgccgggttagctatattagcatagctcacagtgggtgcccagctcctccgggctctttgtggtctgggccagcatagggtggcatcatgtttctcttaaggagctctgttgtgaatggaatcgtgtcctcccaaaattcatatgttgaatccctaattctcaaggtgactgtgtttggtgataaggcctttaatgaagtaatgaaggtaaaatgaggtcctaagggtagcaccctcatccaatagggctggtgtcttcacaggaagaggaagagacaccagagccccctctctctccccacgagagcagagaggacaggcggcgcgaggacgcagtgaggtggcaactgtctgcgagctaggagaagcctcaccaaaacccacattttctggtaccttgatcttgggtttcctacctccagaaccgtgagaaaatagacttctgttgtttaagccaccctgtggtgtttgttataggagtcttagtaagctaatagaagctcctagctgcctccatcttctgagaggaaggaggatggaatttgtaaagatgtcttcaaccaggagagtttccttggacaaagggtggaaatgagcctcagcaggggcggactctcacctggccctcaggtgtgtgctttcctgggagaggctgcatttattgctatggggctgcaggtaatttgcccaaaccaaaatttgcaggtaatttgcaaactgaatctctatgctcctagagattcagtttgctctttctagatcaccaaagaggatgatgaggatgaaatgaggaaacctacagtcacgcaacaattatatcaagcacctactgtgtgcctggcactgggctaggctggggccacagtgatgagcaaatcaaggaaggtcccagcccttgtggagctcacagtctagcgagcgagagatatactaacctagaaatgaaaagattttatattgtaatacaattctgctgagaaaagtaaaacagagacgagagaggacgtggggaatgtgggcgaatctttgctttgaggggccagggaagggtcttagattgagtgccctcagaatcagaccctgaacgaggaaccagagggcagggtgcttatttgggaggtgatcccagaaagacgcagtggaggaatggggaagtgaggcggggaggggagaagccagtgaaggtgtgctaaagagcaggttacggcttcgggcaactgggactccacgctgcaggggttcccgggaagccgcgtagaatacgccgctgacacgtggagtaaagaagggagagtgttaaccaccaacccccaccacttactggtggaggactactcccagggcgtttgccccccggcatttctacctggtcccccaggcaggctcagcaccctcctctgccagaggaggatctaggcagagtcctaggttctggcaatagaaagccatcagcatggacaggagccatgggtgctggggtggggcagatgtgacctgtctgaggaggcgacccttgaaccgacaccaaaatgatgagaaggggccagccacgggatgagctgggagaggagctctgcagataaaaggaagagaaagatctcggccaaagcccttgtcgacgctttcgttgtgtgcaggtcagagggattgttgggacagcctgggctaagggatgaatcaggttccccaggagctgaatcaggttccccaggagctctctctagtctctctctctctttctttctttctctctctttctttctctttctttctttctttctttctttctttctttctttctttctttctctttctttcttcttttctttctcctctctctctctctctctctctctctctctgtttccacccagacccctccctttgtacccatcttcaacggaggcagtgattggctggccagaactgtgggcggggcctttggggtccaatcctaggaggatctgggccattcattggcccctgtgggaggtgggcgaggtggagaaatgggacccccaaggagggaggtgagaagcaggacaagttgacaaattccgcaactacgaatgccctccacttccctagtgctggaggacagggctgagccctctggccattcattgatgctcccatgtcacactggtcatgcctcttggtggcccgaagtggcctgcccccaacaactgcaggtagccccaggacacagggagcaccagtctggcctagtgtcgcaaaggcctagtgccacaaagaccacagtgaggccaattggcacatgtggaccacacagaggggtgctctgcctgtagtggccaaggtagtagtggagcccaggccttggatgttccattaggaagtccctagagtgccctgcgggcatcccctggcttggcagcgtctcagtgtgggtccccagaagcaggcagtgagacaaggactccagtgaaagtcatttatgtgggaggcgaaggaaacagcagcaggggagtggagacatgagacaggcaagggaaggcgccaataagcagcgcatcatcaaaccagctaccgcatcacaccagctactgcatcacaccagctaccgcatcgcaccagctactgtgtgggtgactggagctgaatcccactggggaacccagggagaccatggagacacttctcagggttggttacccctgggaagcaaggaagcaggagtattgaaaagcccactctgggctgggcacggtggctcacacctataatcctagcactttgggagacagaggcaagaggatcgcttgagtcaaggagttcaagaccagccagggcaacaaagaagaccctgtctctacagtttaaaaacattaaaaattagctggatgtggtagtacatgcctgtggtccctgttactcaggaggctgaggtgggaggatcacttgagtccaggaggtcaaggtcgcagtggttgcagtgagccatgatcacatcactgtactccagcctgggtgacagagcgagatcctgtcaaaaaaaaaaaaaaaaaaaaaagcccccatcatggtcagttactgctcaaggctgctttgggtggtcatacccctgaacgtccagcctgtgtgtgttggagggaagactccatccgcgggacttgttggagcacactgaagtcacaagcttgagagatctggattgggtcgacagtatcacttcacttatttggaaattcaattaactagagttatgttctcagtaatttctacaaacccgtggggctaatgtagggtaccatgtcccttatctgacctttgattcctccacccttctcccagcccctagctccccaactcaagcatccctttgctccaaggcacagtgtctccaggagacaccttggaaggagattcactctcgccaaggttcctcatcactagcaggggccacccaaaagcccagccctaactcccatgaagcagagagagcccctcccagctattctgcctgcctccttgttccctctcccctcccctttttggccccagtgtcctctgaactcactctgtctgctcctgcatcacagcctctgcatacgttggccccttttcttagaatgcattcccaccactccagtttctgcctgttgaaaagtttcaacgtgcaatcaacaaaaatgtctattgagagttaggcactgggaatggaacattgactcaacaccacacagaacttccttttggagtttgcactcgggtggaaaaagaaatcagtcatcacacacatttttctatactcacaatacggtaaatgcaatgaagaaggacagggagacacaaacatatagggttggggggtggtggctggactggatctggggtttcccaggaggtttctggggcagtgatatcaagctgaggcttgaaaggtgagtgggtgagaggtggaagggagcatcccaggcagaaggaacaacatgttaggccctgagatggactctgcatagctggtgtggctggaattgagagaaggcaagcgggcagggggcagagtgggcaggggctgcaaatggatcctgagagatttaggaagacaggaaacatttacatctatcaagccgccctgcctgggaattctgagaatgccctaggcttaccctcagctcccctaaatgcagcccccaaatcctcctttaggagactgtgctgctaatctgttccagagacaggcttgggactcactgcccccggcacgccaaaggagtctcatacattcttcaaggcctaattcaagttgctcctctctgagaagctctctaagctgatttcagcttagagagcttctcccacctcccaagtcctccacctccgaagtcctccttagctcttggctctttggcatctgagagcactgggacaggggtgaatattccttagtctgccgcttggggcagggcagcccaggctcttgctccagggacggtggacgatgctgcctggtacctggctgtgggcaggtgtgggccaccacctccaaggacccatcattcctgcctgctcctcacacctggagatcacaggatatgtggaattgaagcttttagggatccataagggacttcatccacagacttgcagggaatgatggtgggctgggggagggggtcatccccttttcttggtttttccaaggctggggtggtagaaaggaaaatgattcctggcaaacccgtgctgctgtcccgtgcctgcctcccagggctgctgagagggtgggagatgccttctattgagaactccccacccccatccccaaccactttgcattctggggcaggggagtgggagccacttgtcattgttcctgtacgttggctggcaggaggcccagggagggggctccccaatagaaaatctgcagctgcctgtctttaaggtaaaattaccgtaattaccccaattactaaatccatcaagagctttggaccggaggcctggagaacaattgggccctgatggatctgaggagtatgagtcacgggggtgggggcacaaagcacatgggatgaaggcgagtgggggcggcagctgatgttaaaccaggggtggggatggggaaatgcaaagagattatgattagccaagaccccactttcctccttcagtgagatttttcttctctattggaaagaaaaaaaataccccaaattctgtctgccttttcctttcacagaaccctgcaccttgggtgggcgttgtgactcacgccagtaatcctggcactttgggaagccgagatggaaggatggcttgaggcctggagtttgagaccaccctgggcaacaaagggagaccccgcctctacaagaaatttaaaaatcagccggccatggtggtgcgtacctgtagtcccagctactccggaggctgaggtgagaggatcactagagcccaggagttcaaagctgcagtgagctatgatcacaccactgcactccagcctgggtgacagaacaggactctgtctctaaaaaaaacacaaaaacaaaagaaccctatactctatggccacctgacttagacccgctttgaccttttatgagagctaaaatgtaaagagttgagagcaatggctagcatctcctgggtcccagcatggaccaggaactatgggaagagcttttcaggcttcctccctttcaatcccatgaagtgggtttcctcctgcttcacagacgtgggtgcccacatttcctcttggcctgggttctgagcagaccagcccctgggcctggttggcttctgtattcctcaccatgcttggtaaaggaagtgaaggacaaggttggcagattaggtgggctactgggaaaagcaccttataggacatgtcccctcttttcatttctattagaactttactacattcaaagagtagttaaaacattcagattcttcctctcagttgatctggatttgtagcctaaggaaataatctctaattgtggaaaggctatatcgtgaagctaattctttcagcattgtttatgctggctgcacaatttcactttaagagaagatccaggctgctgatgcctctgtactccattgccaggaggagttatgtctgcaggaccccaggcatagaagaaagagatccccttggctgaagtagacttagaccagaattgggaggcagatctgggtttccacagaagtcattgggaccaaagcccccacaaattataaaatttaagtatgacctggcttgtccctggtgcctgtatctccaaggtgactttgcagggcttgtaggtgttgctccaagatttaggatgtcagggtccaggccaaatagcttcctaactcatcataactaatatggttaacatggaaaattgtgaaacaatttaatgtcaaaacataagggccagcgtggtggctcatgcctgtaatcctagcactttgggaggctagtagggagaatggcttgagctcaggagtttgagaccagcctgggcaacatagtaagacctcgtctcatccaaatatcaaaaagttagtctggcatggtggtgtgcactcaggaagtggaaggaggatcacttgaatccatgagtttgaggatacagtgaactataattgtgccactgcactccagcctgggtgacagaacgaaaccctacctcaaaaaagaaaagaaaagaaacgaaacgaaacatagggagactggctgaatagatgaagttttgtgcaggcttttaaaataatgagtaaaaagattcctttgaaatctgggaaattacaatagaatgtttattgtcatgctggttttttgttttttgttttttgttttttgagacagggtcttgctctgttgcccaggctggagtacagtggagcctagagaagggcaggagagcccttgaccatcacccaggctggcgccaatcctcaggggctgagccactccctctagaaggcctgggctcaggaaatgcccctgagtcagaaacactgtgggacaatattccctgacattttcccaaaaaagggccctaagggaagaggaaagtgcaggtgagcttggagcaaacatgaactctacccattggctcattcaattattcattcatccattcaaaacactattcttgctataatcctaaacaaattaacccaggaacggaagaccaaatacctcatgttctcacttataagtgggagctaagcgttgagcacacatgggcataaatatgggaacagtagacactgtggcctactatgggggagggggagggtgggttaaaaactacctattgggtactatgctcactaccagggtgacaggatccatactccaaacctcagcatcacataatactcccgtataacaaacctgcacatgtactccctgaatgtatctgaaataaaagttgaaggctggatgccgtggctcatgcctgtaatctcagcactttgggaggccaaggtgagaggattgcttgaacccaggagtttgagaccagcctgggcaacaggacaagaccctgtctctactaaaaataaaaaataaaaataaattagccaggcgtggcagcatgtgccagtagtcccagctgcttaggaagctgatgtgggaggatcacttgagcccaggaggttgaggctgcagtgagctatgatcgcgctactgcactccagcctgagctatagagcaagaccttgtctcaaaaattaattaattaattaattaaaatatgagttgacatttcatttaaaatcaaatgttctcatggtgtcctctgtctacagccctgtgatgggacctggggatactgccatgaatgagacagaactagctgccattccaagcttccaaggcagccacacaagttgctcttttgtgaaattttatgatttcctctcaaatattcacatgaattttacattttattttgtaatgtagccatgcttgtttttgtaattttaaaatgatgttttcacaacaatatgcatggacttaatgccactactggattgcacagtcaaaagggctaaaacagcaaatgttatgatatgtatatatgtgtgtgtgtgtatatatatatatatatatatatgtattttagacagagtttcgctcttgttgcccaagctggagtccaatggtgtgatctcggctcaccgcaacctgcacctcccaggttcaagcgattctcctgcctcagcctccaagtagctgggattacaggcgtgtgccaccacgcccagctaattttgtatttttagtagagacggaatttctccatgttggtcaggctggtctcgaactcccgacctcaggtgatctgtctgcctgggcctctcaaagtgctgggttacaggcatgagccaccgtgcccggctggtatgtatatttttattgtggtaaaatatacatacaaaaatcttacaattttaaccattttcgagtgcacaattcagtggcattaagtccattcacattgttgtgcaaccgtgaccacctccaaaactttttcctcttcccaaacagaaattctgtacccattaaacacgaattctgcatccctccctacacccaccccgggagccatcattgtactttctgtttctctatttttattttttatttttttgagacagggtcttgttctattgcccaagctggagtgcagtggtgcaatctcggctcactgcaacctccgcctcctgggttcaagcaattctcctgcctcagcctcccgagtagctggaattacaggtgtgtgccaccacatccagctaattttttgtatttttggctatcattcattcattccacaaatattggctggttatctgccatgtgccaggaactctactagatgatatgaagatgaacaaaactggacagaacccctgccttcatgcccttcctgcccacaggggaggcaggcattgatcatggcatctctgtcctgtggtactaaaggtccagcagcccatgctgggaggcagcatttcaatcagcagtggggattctgcttggtgggctggcccagatcccagtgtcccatcacttttctgagctcggttttctcatctgtgaaatgggagtgatcactctccccatccaaccttttggtgtggcaggatgaggttctctgttcctctcaccctcttctttcctccctcctctgtgagatcagcaaaggcaaattctcatccccattttgcagatgagtagactgaggatcagggaggcagggcagagtcttcaccagaatctttcccaggatggtccctgtccctcactaagtcactggatctgctctccccagcctgggggcactgccacccctccagctgggctcctaccgagtgccagtcaatgtatcctcgtgtctgagggcaaagactagaggcctggcaggactctcccagggtatctcctttttacctgtgtcctcccaccaggcagggttccctgggctccagcaggtgcaggcaggaaccccccagggcactttacttccccagccttcaaaagagttctctgcctatgttgttttctgtccagttggagcacaggtcccacagtcacacagaccaggtcttagttctttgctgatctgtgggaccttagctggggttctctaagtctcattgtcctcacctataaaaccactccctctggttgataaggaaactgtgctcacctggtgggacactgctgcattcaccaactcaggctgccataacaaaacaccatagcctgagtggcttatgcaacagaaatgcatttccttccagttgtggaggctggaagtccaaggtcaaagtgccggtagggctggtttctcctgagatctcttacctgggcttgcagatgtgtcttcacatggctttttctctgtgtgcctgcattcctggcatcctcctcctcttataaggacacccgtcctatgaaccagggcccagcccttatgatgttccttttacctaattacctccttaaaggtcctatctccaaatgcactcaccttgggggttagggcttcaacctacaaattctgagggattgaggaagacacaattcagtccataactactcagcaattaaaaggaacaagccactgatgagcaagagaagccagacacaaaacgtagacatgtatgattccatttatatgaaatgctggaaaagtcagaacgaatctacagtgacagaaagcacagctgtggttgcctggggctgcaggaggggagaattcttgggacaatccgtgggagaactgactccaaagggttccaagggggctttctggggttgatgaaaatgttgcctcttgattgtggtgatggttgcatggaaatatacatttgtcaaaactcattgaactggatgctgaaaatgagtgtgtaaattgtatgcatgtaaactataccttgctaaaataaaatttaaaaccctacctcaaagggttaaaaaaataagactcaagttaggtggttgttaggagtaaatgagttaatgcctgcaaagtgcttagcttggagcctggcatggtgtaagtgtgcaagtaaatggtaaccatggtaacctgaaaacaagacttttgcccagtaagtggggcaagaaagagaaataaacacagaaggcaaggggtggggagtgatgcttctcccatgcccagagcagacaggcaggggctgtgatctcagcctcctggagtcatcgggtcactctcccggcccaggcgaggattcctataatgcctgtcagcatcttttgggccctgggggcagccaactgcaacttagcccctgttcagccctgatcctgttttttttttttttttcattcattcactgaacatgcacattggaccacctagcacaacaaaagacaataatagctgcttctgtttactgaatgatcttatgtgctcagtgcttgacattttgggctgaaccaaatgaaagagccaagattccaccagtttttacccacaaaatgccagtttactgtggttcaacctgatacatgatctctttcattgttatgacaaatctgagagtagatatgattatttccattttgtggctgagaagatggaaattcacagaggtgaagtgcctggcccaaggtcacacagctgtgagtagctggatttgaacacaggtctgactctgaatcccgtatgttacatgttccttgcccttaaggagtaccggtctagtgtagggatgaacacattaaatacggcccccggggtctcgcccactcaccccctgaatccccccaacaggctgccctcagcttttcagacactggacatgagtgttcttggtcttccaatgatgccaaagtcctgccgccctgcaaacagctcctctgcccaccaggacatcttgccttctccggacctgcttctccccggacctcgggggttgtgtggtcagtgctggctggtccctggtgaagctgtacttatgtgtctctgttgccccaggagttgccctcattctgcccatcttgtcctcactccaagcccgccccttcttaaagactccctctgagttcaggttcgtctttaattcacagctcattagtagatcaaagaggacagagacaccctgagtctaagggaccctcaggcagccccatcctcacactgtaacaaggtgcccccttggcaggagacaaggggatctccctggctgctctttgtgaagcaaggagagggggctgggacctggctccaggctcccccatttataacagggccagaggttcagctggcagggctgaggcagaggcattggaaagccgtcagcccctcctccagagcctgagcaggacaaggacagttaattcctctggtgttatcagctgggcacaggctctggttgcatagcaacccggattgctctctgcctctagtgttccaaaaaaaaaaaaaaagcattttctccaactccatgaaatggaattgggcccagggcagcccaggctccctgcccccaagtgtggctcatttgtaggaagctccaacccatgccctgctgtgggatccccactcttaaggccttcatccccgtcttgcctcacccatgccaggctgggggtaggaattcacccaccaccctactgctgcaatgtgaagctgggtcagaagtgaagtctcagtttgtccaaggggatgctggacaggcctgggatctgggtgaaaaggcatgaactgggggagcccagccagttctggcaatgcagtttacttattcattcattaagaaatatttattgggcacctactgggtcccatacccgtaaactccccagatttggtgagttaaagatggctgccaactctttgccactccttccatgaagaagtggaatccaggccgggcgcgatggctcatacctgtaatcccagcactttgggaggccgaggcaggcggatcacgaggtcaggagatcaagaccatcctggctaacacagtgaaaccctgtctctactaaaaatacaaaaaattagccaggcgtggtggcgggcgcctgtagtcccagctacttgggaggctgaggcaggagaatggaatgaacccaggaggtggagcttgtagtgagccgagatagcgccactgcagtccggcctgggcgaaagagcgagactccatctcaaaaaaaaaaaaaaaagaaagaaaggaaaaagaagtggaatccatttcccttcctcttaaattggggctggctctgtggctggtctggccagtggaatgtgacagtagtgacaccgtataactctgagactgagccctaagaaattagcagattctacctttgcggcttgaaatgctccttcttggaacaccatcaccatgatgtgaagaagcccaagcagccacgtggagcggccctctttaagtctgtatcatttaccagttgcatgagtaaagccatataataccatgtgaagcagaagaatcctccagctgaaccctgaccaggtccttgacccacagaatcatgagcaaataaaactattctccctttaagctagtaagctttgaagtagcttgttatgaaataatagataaccaaaacaccaggagagcttagttttccattcatagattctcaaataccaacacatgtggtttaagtacctgatgtatgctagaccctgtgcccagttccaaagcaaaatgccactcacgctggggaactggaggcatcaggagacggcacagaggcagagagcagaaccaagagcccagagataagagcagacaattaaatagaaaccacctataattaaaggggtcacaaaataaggtggggaaggcaattttcattgctactcagaccacacagtgttgaattcaggtatcaactctgcatatttggaaataggtgcctgggccacatgggagggattctgaggtgaagtctgagctccggggtgatggattcatggtgtctacagtagttggggagaggagaatgcaggtacctgtctcatgcctgtgcttcttgagcccatgctgtccgctggcctctgtgactaactcttctgcacctacttagacaaggagagaggcgggaaaacaggttgttcaggcaggctttgtgggggctagagcagagaggaccccaggcatgcattcatacttttcaaactggagttatagacctccttataaaccagcagggcagcttcagagggttagtttttagtttagtttagttttgttttaaaatgtcttctagtcaatttagttcaaaattccatcatcttgttctgtattcctgggtcagactttcacctggctcttttttttttttttttttgagatagagttttgctcttgttgctcaggctggagggcaatggcgtggtctcagctcactgcaacctccgcctcctgggttcaagtgattctcctgcctcagcctaccaagtagctgggattacaggcactcgccatcacacccggctaatttttgtatttttagtagagatggggtttcaccatgttggccaggctggtcttgaacgcctgacctcaggtgatccgcccgcctcggcctcccaaagtgctgggattacaggcatgagccaccgtgcccggcctctttttaatactgatgtctgggctctacccacccacccgcttcatgcttgggagtcactattttacaactcctcagctgattctaacatgcagccagggttgagaaaatagcgcctaacccttggagacacacagctgataaaaggaaagtcttcgttctcaagaaacgtctaggtttggggtggggagtcgggggtaagtaggaggcagttgtgtgctgaaaacgtttctgtgttccagggaaaaaaggcttgatttttagcatttgctgatttttgtgatatagatactttcactatggccgatttcaagccaccaatgtgatgtaactgaaagctgggttgggatgagaggcacaatggcacaccacatactagaggcaggcacatccacagctcatgacaacgctgggtgagaagggctgcagttactttgcactggaccagcatcagaccagcagccttggcaccacatgggtgctggtgagagaggcagaagctaaggttcaccccaaatcaactgtatcagcatttgtgctttaaccagatctccaggcgattcatgagcacatccaagtttgagaaactctgctccaataaatggatctgtaaaaaccttttctggggcctgacatggcatggtggctcatgtctgtaattccagcactctgggaggccaaggtgggaggatcacatgaggccaagagttgaagaccagcctgggcaacaacatactgagacacctgtatctacaataaaataaaataaaattagctgggcatggtggtgagtgcctgtagtcccagctactcaggaggctaaggtgggaggatcccttgagcccaggagtttgcggctgtgacgatcaatgattgtggcagtgtacctcagtgtgggcaacagagtgagaccctgtagaaagaaagaaaagaaagaaagagagagagagagagagaaagggagggaagggaaggatgggaaggaagggaagaaagaaagaaaaaggaagaaagaaagaaagaagggaagaaagaaagaaagaatgaaagaaagaaagaaagaaaagaaagaaagaaaagaaagagagagagagaaagcagatggaaataaccatacctagaagggtcagagaaaccttcccaggaagagtggcataagaattgggtttcaaaggatgagtaggagttttccatacagataagaggtaagaatggggaaaggaattgttgagagggatgagtatggacaaaggtatagagtggggaaaaagtggtgtggagagggcatggggtgtagtgggaggagacgaggctagagaagtgggttcccaaagtgtcacctgaccagcagcatctgtgtgctggaaactcttgtgaaatgcaaattatgaggctcccctcctaaatctactgaatcagaaattctggaggtgggactagaatctgtattttttattttttatttttattttttgagactgagtctcaatctgtcacccaggtggagtgcagtggtgcaatctcggctcactgcaacctccgcctcccaggttcaaacgattctcctgcctcagcctcccgagtagctgggactacaggagtgcgccaccatgtccagctaatttttgtatttttagtagagacggggtttcaccatgttggccaggatggtctcaaactcctgacctcaactgagtcctgatttctgagagacagacaacggcatgtgtgtgactgacaagtgggctctgctgagcaccgatgggtttgctgatgggacagttatggagaagaaatctcctgaaagcatcctccaccttgaactcaaactcactagtgaccttggctgagatgtcacttcctctgtaaagccttctccctgccagccactctccatcgctgtgaccccactgcctcctcagccctccccattacctctcaagctgttctctaatggcttagctgtccttccagcacaaggccaggaccttgtacatcttggtatgacatccccagcacactgcctgacgttacccccattccagcagctcactcttgattgagtacttactgagtgtgagcatcatgccacgggctttaccggagctgtgtcatttaaacctgagaactgccctatgaaatgggtactattgttgtcaaccccattttacagatgaggagactgaggcacaggaaataaaatacactgctcaaagccacatggctggtaagccacaggcagcctgcctccaatagacaaacacattttgttgttgttattgtttttgtgcttgttgcaggaagggagggaaagggggagggaaaagtgggatttcctgagcatctttatcacccatgaggtccacagtgccctcccagactgctggctattctcccttcactctgagggacactgcggaaggacctggaagagctgagccttgtccaggagcagtggctgctttatttagggcctaatgagccagtgtctctgctgtgactcagccacggcccaggggtctccagggagaggggactgtctgcaggccctggctagcaactctctgctaacagcacctttcagctcccgctctctcagctgctgtagccattagtgctgaaattagcatcgtaattgccttttaactattcttagctgtgaaagagaccaggctgccccgcctctccctccctgcctagagagcagtgttggcttcccttcctggatctaaggaccaccccctgtccacactcccgagcctcagtttcttcatcctccaagtgagggtgataatccaagcttcaaaggcttattgtgatgcatataaaatgcttgtcatagttcctagcacactgtgagcaatgatgccagttgttgtgtttggagacccaggagtgcaaggatatgtatgcaagtccatgtcataaccagcgttagtgctcaggtccttttgactctgagcttagggctcttcctgtcccaccgtgtcaatccttaaaatgtgcctttccctgccaacaatggcttgtttgtaggctgggcagtcactcttgtaatcccagcattttgggaggccaaaggggaagaatcacttgaggccaggagttggaggccagcctgggcaatgtatcgagatcccacctctacaaaaaattttaaaaattacatgggtgtagtggagtgctcctatagtcccagctactcaggaggctaaggtgggaggatcacttgagcctgggaggttgcagtgagccaaggtcacacctctgtactctaggctggacagcagagtgagatcctgtctcaaaacaaaacaaaacaaaacaaaacacaatcatatgagatgacagtaaacaagatcttgcctgaaaacattcagctttgtcatcataattagaagatttttactacaaaaaaatcaggcctcggtgaagagaggggactcaccccaaaggagttgcaaccactgggtcatctagtttgccctcttaaaagtgtgaacactaacttttgatatgcagcaaaaggttgaagggacggatgatgaagcccagctgcctggttccagtccagttctgccactccccccagggtgaccttaggccagttacttaacctctctgtgcttcggcttcctattctgcaaaatgaggataataatgcctttccggcaagtgtgttctgaggtatgaatcagtcaatgtagtgaagcacctggcacagcagtaagacacagtgagaaccaggtaagtgtttgctcttattactcattaggcatctttacttacttgcttgtgtggcttctaaactgcagtttggggagggggttctgcaatcatcagcagcaaattgtttttaggccagtcaccatcacatggacgatgttttcttacccttggtttagacttgaatcccaatcaggccaggaggggagatccccaggctgaccccgtttaaggtgcaaaaactgaggcttgagaaagttaagtaactttcccaagatacacacattataaaaagaggagcctggccttgaattcggtcaagtctccagtgctgggcaccaagtagcaggcccctcagctggccctgcatcttcttgggcctccccataacccctgtcagcaatccccgtttaatgcgaacaccatatccttccctcctggcggaggcatatctggcagtgcttaaaagcacaaataagctgagattgatatgaggatgaattgaattaacatttatacgaccagtacagggcgtggcacaggatgagtgctaagttagtaatatttatgatgatgatgactattactattattattctgagacagggtctcactctgttgcccaagctagagtgcagcggtgcaattaaggctcactgcagcctccaccttcagggctcaggcgatcctccctcctcagcttcctgggtagcttagactacaggcgcgtgccaccatgcccagctaatttatttatttattttgtagagaagaggtctcactgtgctgcccaggttgctctcaagctcctgggctcaagcgatcctcctgcctcggcctcccaaagtgttgggattacagatgtgagtcactgcacctggcctattattatttagctcggaaaatcaaccctaatgacctcaccggatacaccacttccaggcttggattttaggttccctacacaatttagggctgtgtcctggctttaaatatgtaaatgctgctgtgagaaacacatcctcgggagggagaaggggtgggctcagaacctaagactttccaggaactcagatggggacttgggaaagctgtaaagaagaggtccctgatcttatgaagtttatggaaaactacctaattacaaaattacttcacgccttgaaaaagaacggaatgaacaggacgctatcatacagaataacggaggggtggggctccacttctgatcagagggtcagggaggacctcttggaggcggtgatagttaagctgacacctgaagaagccagtcatgcaaagagtgggtcaacagctttccaaggcagagggaatcaggaaagcgatgggcttgtctgaggaacagaaaggacaacgaacgtgtgagtcacactaaggggcgccgtggtgcggcatgaggctggagcctgatcactcggggtcttactggccacggtgaggagtcagggtttcatgcgcccctgcagtcagaaagcatggcccaaccccagtgccctaagtccggaaacattcaaagctggacccagggtagcgggatccggggcctctggggacccgagagggacgttaagttcagggcttcagggtgcagccctggggtcggtacccccagcctccaacccagagctggcagcgctcgcccccttctccgcgcgggccctcagctcagctccctcttcgctccccgtgtccccgcgagcgggagggaggggatgctaggacgccctgtcggcgtcgtcgccgctttccgccattgtttagtcgtgatgctctcattttctctgaatcaacaattttctgctcggctccgcgccgaccggcgaacgcggggcttttcctcgcccgcctgatgacagcagagcggcgcggagcagctggtccggaaggaagcgccaggcgcctgcccggtcccaggcgtccgctgccgcccacccacaccagaccccgcccccgcgcgtcaagccccgcccatccataccaagtcccgcccccacaccctcacccacacaccaggccgtccccaccccgcccccagagccccggggcgccccgcccgctagccgcgcacgcgcagtgagcacggcgacccccggtggtcgggtgtctccgcaggccgaacacgctgctcgcccagctgcggatcattaccgcccttttgttctccgtcgcgcgctcgccccacgctaggaatgcaaactgtaggcgccgccagcccccccttcctgtttccctgggtgggagtgggaagggagttttaaactgaattgtgctcagactcccagcccagtcttcccggagccatccgttccttcatccaatgcggacacccatatctaaggttcgggcaggatttccggggcaccctcaaacccagcccgtgggatccgggaaggcctcctggaggagagtccacgaggcacggagccgaggatggggttggggttaggtcttggagggcttcgaatttccggcaaagggtctgggatggttcttgaggacagcagggatttgcagggaggctgggggtggaggtgggcagaggtcttgctcacatttgtgttctacaaaggtccttttggcttttgggaggcggagactgagactggagtccagaggaccaaggaggacgaggtaactgccgtggtccaggtgggagaaaatgtcggtgaggtcttgggggatagaacgcaaaagaagactagggagtaaaatttacagaaccagtggctagtcaagtttaggggtgagggggaaaatgaggacacccccaagattctgacttccgtgaccatatgggcggggggacgtctcctgagaaactgggaaggaatgagggttgctgggctgagcagatgagggagacctcgttctcccacccccttcctaaccttgtactttccacacctacgtaagtaggccctcgtttcacacaggcctctgttcagcgtcccttcctctgagaggcctttgctgaccaccttttgtaagaccctccccatccccataccctacccactgtttcttcacggcactgaccacccaaagttgtatttggatttgtctattggtttcttttctgtctcccccacaaaactgtgagctccttgaggacaggggctttgctcggttctttgcagtatttccaggacctgggacaccattgcctagtctctgcctaaagaatgcatgaatgaatgaatgaggcagtgcagggtccaggccttgctggttcatcactgcattctgagctgagcactaaatagcaatttgctcaataaatgcatgaatggatggatagttgcttcacaacctagtagataaaatctaggccgggtgtagtggctcatgcctataatcccagcactttgggaggccgaggtgggtggatcacttgaggccaggggttcaagaccagcctggccaacatggtgaaaccctgtctctactaaaaatacaaaaattagccagccgtggtggtgcgcacctttagtcccagctacttgggaggctgaggcaggagaatcacttgaacccaggagtcagaggttgcagtgaaccaagatcacaccactgcactccagcctgggtgacagagtgagactccgtctcaaaacgaaacagcctggtaggtaaaatctagagtcataatgtgaggagcagtaccgtgagataccatcaggataatggattaataatagcccatgtttattgagcgcctccttcacaccagggctgtgttgcctgctgcagatgggttatctcagttagtcctcatgtcatccctatgaagtaaggactcttggtggctccatttacacacatgaggaaaatgaggcccagagaggttgaatgatatgcccaaattcacacagctagtaaacggcagggccaggatctgaacctaaggtggttgcactattaccaagtcacagcacagtacatggatgctatggcttggtggaaagggtcaaaagcatccccacacccagtccaaggctcctcctaacttagatgatttcttctcaaagggtcagaggctccatgttgccccagccaggcccagaacagcagcagaggtctggctgagtagagagatgctgatactaagtctacctggccagtcctcgactgtgggaccagcactccacttcatgtgtgtgttataacattcgatcttcagagcaaacttggtgaggccctcgcggtaatcattcccattttccagatggagaaagtgaggcgtagtgaggtaaaccagcttacctagggccacacagctattgtgtgggacagctggtgtccaaacccaggcaggctgattccagatcccacctctgtgcttcctttaagctgaccacagcaggaggctggatgaggccaggccagctcaggctggccattctcagtgccagatggtggctgccaggcatggctggagcggtgtttaccctgtggccattctgcctctgcccattgagagggcagccctctcaatcatcataaaccgaggctgaaccaagatagcaaatccgcatcctccatcccctgtcactggacaccctgtattcaatcacccacatattcatttcttctaatctttctctcttgactgtgataaagtcacttttatagtgctgagaacgtgcagttcatttgaattaagtctgctggagtagattagtttgtgtgggaaaatcagggctataaaagaaggcatatttcaatggttcttttaactgattatgctctagggtcttattgtaagaatctcatttggggtgtggggtgtgtgtgtgtgagagagagagagagagaattgcacactcacttctagaaccctggagtgctgaggaagaccacctagaagcctccctataggaagggtctgggcttcccttagagaaatgatgaagggaactctgctattatctccatcaggtggtggctgcccaacctctggggaatggggcagataattcactctcatgtaggagggccctaaaagacttgggtgcagctgaagatgatcagctcatgcccaacagagtgcaatggcaaagaaaagtggactgatttgaatgcctccagagccccatctgggaggagagggtaggcagacattgccaatctgagggttattatgcagttactgtctgcctttcctgggagctctttgaagatagtcctgttcatcactgtctgcccagtgcctgaccctttggaggccctcagtaaacatttggtgaatgaaaggatggagagaatgaggagagctggccatcaacaccagctgtctacctgggccaatagagaagttgcccctaggaagggtagacccagcaaaggtccagggcatcagggtttccagacccagcagctcatgcttgacattcaagcctcagaagcaactgtcttcaagggactatgtgagtttggacaatgagcatttcagcagtggccagtggaaatggaagaaaagaggattctccccacatgacctgctctggataaacccttgtgacctttcttccactggcaggggtaggggtgtggtgaagaagcttcattaggacaaattaatttccttcttggccaggtggatggggatttaaaactgaccccatttgattcaaagaaataagtgatgggatgattctggctcctaaaattatggggttaattcaacttatttcaggagtattaaatggggttgtacaagtgcccctggtcctaggagaacctcttttaagttcctccacctgtcaagatgactactttgttacaagagctagaatctacaagaggccaggtctgctagggcctcccaactgatggtacaacagacaacctgtggctgaagggagagaccttctaaaacagccagccttggccagagctgtcatgtctaaggacagcatgtcactagttcccccaggcccctctgcctcagcaccctctcctctccagttacctcctactctctccctccagagaggaattgcagcatggggtgattgatggctatcaggtatgtgattatgcatgtgtgtccaaacccacctatgtgggcatgctctgtgcgtttgtatgtttgctctctgtatatgagaatacgcgtgtacatgaacttgcatgctctgttagggatgtgcttatgtgtgtgtgcacatagagtctaggttctgtgtatgtgtgtgcatgtgtctctgtgcatgtatggactatcacatatagtcacactgtatgtgtgactgtgtgaccacaggatacagggccctttgatgatagagggaactcccccaccacctcccctgcacccagagcaagagggcttgtgttggcaatggactggccttctgtaggaaaagtccacccactgaggggcctaggtagatctagtcacagcctcgcattagctgcttccctgcctcagaattctcctgggtggtcaagccacggagaagcaagtggctcccatagcaggaagaaacagtgacaatctcaggtaccctgtctgaagggacagtgtggtcctggcctgtggttgttcaggattctagtgtatagatggggtggtaacttccaagccatccaccacttttctctcctccaccaatgcaggggtaacatccatcaggcaaggtgctggcagttttcatcctggctctaagtccttaggaaagtcatgtcacctctctgagccttacttttctcatgagatagaaaacctcacaagattgttaagaattacataaaaattaaatcctgtgtaaaatgagaaaataccttctgactagccacttcctgagggcatgggcatgtcaacttatcttcgtgtcctcgtgctttgcctgggatctggtgtatggcaagctctcacctcatatttctataaacaattttgaaatatgtaagcctttgcagcttcccaacataaattcattcactcatttattaattcagtacacttttatggagcatctactatatgtttgacactatttggggtattgggaatagagctgtcaataaaagggcttactttctagtgcacattagcatactaaaggctctgagaagtccagcagtaccaggtttctgataaactttgtttaacccagcagtctctgtgtttaattatggaattccccacacctctttcaaccttttttttgctaatatgcaaatttaatcctgttccattcctcattacctgttacactcccaactctaagccccttcagaagggctatggaatataataattaaaacaactactctggagccagacacctgtgtgtgtgatcctgggtaagcctcaatttattcatgtgtaaaatggtgataatggctaggattaagtgagataatgttgcatctccaatgctcagcattgtgcctggaatgtagtataattcatttaaataacacctatcactccaggtctcctcaacacctatgaggtaaggccaattgtcctacatgatacccaatgccctaattgcctccccagagttatctgaaatcattctcctccaactctcttttatgagctggtcattcggaaccacttgccagttcccatggctctcaaacagccgcctgttgtttcatacctttgctctcatgttgcttcctcttcttaaaattttcttctcagtctttcctacctggagaacatacattacattcatctcccgagtcatcccctaatcacctcctccattaaacacgtactcactgcctgatccttcagccccaactgatccaccagccaactgtatttgcatgagttatccaggcaagaccagtagaggaatcacccagttcatctacagaatcatgagaaaataatatgtcattattgttttaagcctttaagttttggaggtagtttggtatgcagcaatagacaactaatgcaagctccttgaggccaataataactaacttcaactcatcttcatctcgcaccttgtcattcagaggagtacatggggacccctaggaccattggtgaagccaggagagagtgaatgcccttggttgtctccattccagactagaggggggataaatgagggacctccactaaaacatcagtggaaggaccctaggaagaatgaactgtctagagaacagaccaacagatcctcagcggacactgtgagctgtccagggtcctgagtattctgttctaggggaacacagtgccatgctctgatctgcccactcctgtgccagggtcaccctactcaagacccgccctagtgattgttatgctgacatctgagagaaccagccttatagtgggaatagaggatttgacatctgctcaaatggaattgaagttgattcttacaccttcacccttccttctcccttccaccctccctctcaggaacgatttgaccattataataaaaatccagctttatgtaaataccctatcctccaagtaataaatgccattagctgagcctgactgagcaatcgcatgcttttaaacatccatttgaagatctttgaaagctctctcgaggctcttgctcataattcactaagtgggagttggtaataactgtgttaaatggccaggccctgcaattcgcggaggtgtgtctgtttgtgtgttggtggtggtagtggcagggggtgctgggaagaggatgcccttccttccatgctgatcggttacttatttttaagagtcccactgggggctcacagtcctttgatgagctactaatgaaagagccagatctaacaattaatttccccagagttattatttattgttttggcaacatttctctgaaaagccttaatactcacctggcttcctgatggttgaggagaaccatgggttgagaagagaaattagttttacctgtttattcaacaatcatgaattgagcacctgtgtgtgccaggcactgcactggagcaagatacacccctgccttcagagagtccccagtttggtggggggcaagatagggaagggagcaggcataacaatacagtctaatacctatgatagaggggacaatgtagggggctgtgggagccaggggtggcacatagccaagattgaaggagtcagggaaggctacaagaggaagagtccttaatgatgacctagagctaacaagataaataaaaaatagggaaaggaaatactgtgagaagaaggaccagtatcttcaaagactcttagaagagaaagagcatccataaaattctggtgagatagtgtagtactgagaactttgtcactgctggtgggagtgtaaatttgtatagccatttgggtaaacagttggacgctatgtagtaaatttggagatatgcaagcccttcaacccagcaattccatttatgtctagagatacttctgtatgtatacaacattaggagacatatacataataatcagagcagcatggtctgtaataggcaatgactggaaacaaccaaaaacctatcaaaggcagaatgagtaattgtggtgtaatcatacaacagaatactatacagtagtgaaaatgaatgaaccacagtacacttcacaacatggataatttttatattgacacaaatacatacaacatgacttcatttatattaaattcaaagcagataaagctgaaatattgtcctgggatatttactaaggtggtagatatataaaagaaagcaacaaaatggttgaccatagtgttttatttcagggggaggaagggacatgattggggtggatcacatggggagtctcaggcgacatatatgtcttgatttgagtggtgctcacatagatgtttagaatttttaaataaattgtgcacatttatatcttttatatgtttctaagcttgtgatatatttcaatatttttgttaaaagaggcaaaaaagcatcattgtagcctgagtcactgggtccttctctgaacataactgtgagaagcctggcacaccaatgggagggctgagggtggctctcaggggaccctctggtgccagcatccttcttggctgtgtttctgtgtggtgaataggcaaccccacaatggcagtaccaagggccacataggatctgaagttcttttggatgcttcttagatcatctccatgagatatggcatggctttgtcatccagaagaccaccagatggctaaacagtaaaaaagagctttataggtaatatcagtttgtaagctgggaagagaaagtctccagcatggattaaaggtgctctctctttgaagagagaaaggacaggttggattttctgcctcacagcgtccatgttacacaatagagtcatacatagtcagcaggtttaggggaaaaggtatatacattcatgaggggagctgagcacatccacgcacactaggtaaatatgtatgtaacatacatcccatgttcactttggggtggggttttagcattaaaatgaggtagaatttggctctttatatcaaaaggtgaactataggacagaaagatagtttgcacacagcctctataagctagctgaaaatggcttaaggtctgcaattgcttatgataaaagaatgcaagctcagtcctctgtctagtcagagctgtagtggtctgggttgtaaatcagagctaggaggggtctgatagctcctattgttagggagcttagagctataggaatttagaaatgtgccaggccagtcaggacctgaacccttaaccaataggtaactttgtttccttaacgtttgggttcatcttagttgataaaggggcatctattttggcctctcagatctctccttagtttccagaggaccccacatgggcctgggtgtgagtttcacagggtaaaatggagtcaggtgatgctctgggagaacctgagaagagagacagcattgctttgtctttccacttgcaagtccccaggatgggttaggattgtaaggtgctatctggccccaaaatccaacttcagggcagggtctctcctagatggactctgcagtgggcacactagaatgaacattgccatgaggatcttgcctggttccaggtgactctgaatctttaacataaatggaccttgatcccaatctggggaagaagatgggtgttcccaggttgtagcagctgggaaggatctcagtggtctcttgtatccagcccttaggactttttggcttttgattagctctcaagccaactttatagttgttcatttataagagtaatatattctttcagaacaattatacaatgtggaaatgaatatagaaagtattatggtttcccttataatctcatgttgcaaacaaacaaacaaaataaacaaacaaacaaaaaacaatattaaggccgagcttggtggctcattcctgtaatcctagtactttgggaggccgaggtgggaggactgcttgagcccaggagtttaaagccagcctgggcaacatagagagacctggtctctaagaagaatagaaaaattagccagatgtggtggcgtgcacctgcagtcccagctactgggaggctgaggtgggaggatcgtttgagcccaggaggttgaggttgcagtaagccatcacacacaaaaagtaaataaaaataagaaaagaaaagaaatcaatattaatagtctggcatattttcttccacacattattccaagctcatacacatatgtacaaacacagtctggagctcatacacatatatacaaaaacagtctggagctttcttcttttttgtttcgaaaaatgggatcatgctacgctcattactctgtgatttgacatttcacattataatagatcatggatatcattcaagatcagcccttccagatctaatagacttttttttttcaatagctgtataatattccccagtttggatgtagcagaatttactcaacctgtccgctgttgatagacttttaagtaatttccattttttgccactacaaataatgttcaggaaacatccattgcttatatctacatgtcctaatgcatttctttgtgtaggataaatccccaaagctaaactgtgagtgaaagaatgcacttttctattttaacaagtcctgacagattactttctcaagatgttgtagtctttcacacttccaccaatgacataggacattctcatttctctacaccctacactggctgctatcaactcacaacgttctcttccctcaatatgatgagcagatgagcaaagcagaaaaacagcagaaataaaaacaacaccaaaacttattttattctatttgcacttatctgattactattaaggttggttattttctcaaatgtttgttcattgtttgtattttcttctccaagaaatgcttattcatatcacttatccatctttgtatcaggtggtttccctttttattactgatttgctgaagatctttgcatattaagtgattaagtgtgtctcttgcatgatccttcatttataaagatagaaaatgataaatgataacagaggggaagtgagttgtccaaggatatgagaatgcaagtgtcagtgctagacagggtcatgcctctagattccctgcccagggtttaatccctggcccgctccatagctcagacccttgtggacaactttctgggaattaccagaacacattttctcagagtatgagctaaagacttccttcatcagaattatctggtgcttcattaaaattcagattctgggaccacatcccaaacctatttattgagtcagaatctctagaagtggggccaaggaatctagattttaagagagctttttagattgtccttgtatccaccaaaattagagaacaattaccccagaaactcaaagtccttgcagaggcactgagtgggaagagaggggtaggaaagctaatgggaacattgtgtagcgactcccaccaccaccaccaccatcaccaccagctgaagaaagagccctcaaggttgaagcatcaaaacagagctatcactggggaccttttggcctaattctgcccttaagccacaatcaagcctttgtggcagtaggggtgaatgtaatatatcactttcttatcggtataaaggtgtaaatgtcaatttctcctcctttttgtgaagatttgacaaagcacttagagcgacacccattttaatcaacaaagcagccagaaagatcacagggcatcaagtgtgccatatcctatctgagctttgggtggatttgaaaattgcacttttaattaaaattggcatttccgcagctcagattggagctcgccgttttgctagggaattgcaaactgcgaggcaaacaatctgagagggaggtttaagaatacgaagaggaaggcttgtgtatgaacaggaggcgcttgtttaaataatgaagcggagaaaagataatgtaaaaatgcctttgtctatgtttagttaggtttcctcagagacccgggtaattgcggctgagctgtccgaggtgctgacggctgggcgagaggagcggttgaatgtatgcacaacgcccagaggtaaatgcctggtccacagttctcagcccaatcaagtttgccctgctttatgggtttcttcttggccaatgacaaacaaacttccaggcaggtgattagtaacttttgtggattgaacgaatgaatgattgctgaccacctactatgtatagtatatggtgctctgaaaaatgggaaaaatgtcaaccgaaattgttggatccttttcttgtgatgttgcagtcaacctcacaattgatcttgttgtgagatttcaggattttgtgaaccagaaaaattgcaagccatcaaggacaatgccaagcgaagacatttaagagtaacaactatcacctgttctctccaatgcttgaataaaacaaaaggcattttaaaacttaataagtaggaaagccataatctcagaataaggaacagttatttagaatggttttgtaaaaacttccttgtttgcccttttttctaatttcattgagaaacacaggaaacatcaccatgcattgtcatcagcttcaaaactggcatttgggagtcattgatctgggtcctcaggaaagaaatagaatctctcaaaaacatgttaatcagaggcgctctgacttctggctgcacatctgatctccagggttagcctgttttacagttttattagaaagttctttccatagttacagtgccttaaatatgtgtgggagagggtctggggggtaggcggatggattaaaattgacacttgttgagaacccactgtgtgcaaaaacttaaactgtcttaagatgctacacttaccttatcacacataatctggtttttgccctcatttgttagataggcatcattaataacccaatttaaggatgggaaagttgttacacatcagaatttaatttataataaaagaactttcaaagatcaacttagaagggaacaatttgtcaataatggtataaagataattgatgagaaaaaattattttgaccttcacaccagagcagtcattaaatacattccaactgaattaaatgcctaggtgtaaataatataaacatataacatatttttgtgcttcttttttttctttgtttcttttttttaaaaaagggatacatttgcagaacgtgcagattggttacataggtatacatgtgccatgatggtttgctgcacctactgacctgtcctctaagttccctcccctcaccccccaccacccaacaggccctggtgtttgttgttcccctctctgtgtttgtgtgttctcaatattcaacttccacttatgagtgagaacatgcagtgtttggttttctgttcctgtgttagtttgctgaggatgatggcttccagcttcatccatgtccctacaaaggatatgatctcattcctttttatggctgcaataaaatattttttaaacatagataaaacccagaaaacataaatgtgggtagtcatcagatatcataaggtaaaagggcttttcaaaacttagcaacaactgaaaaaaaaaggaagaatgaacaatgttaattgctgggatgaaaggattctattagacttaaatctccttttgtaaaagttgatattttgcaaaaatgaacatttcaaattaaaacagtgaaatccatagtggttacttctggggtagagaagttgaataggaatcttatggggaaaatgttctctatttccatatgggtgaaaattaattgaactagatatatatttgaaataagcacactttactgtgtacttataccttgattaaaaagtaaaaacagaaaacaaagtgaaaaccattctaaatgcaatatctctgttttgaactaccgaggggaaggatatcaggttcccagggtagtaaaacctcttgaaaccattgtgtgttgtgtgaatacagtccactgatttaaccctagtccacatgaaaaagatttgaagattctagttgaccacaaactctagaatgtcaatcatgcaactcaattagtatcaagaaagcacacaacccaaggttttattgctaaaggcatagagctcccaacaaaggaagtaagagacacctagcttaggaccatttctctgacagactgggtaatttttgaataaattaatgaaactgattgtctttcaagacaatatgtaaggacagaggcaatccagcctagacgttggagtaatattggcctggatttcaattccagatctgccaactacatgttgtgtgaccttaagaaaataatgtcatttctatgggctcagtctcctcatctgtaaaatggggataataataatataatcactgaaaggctgttgtaaggactaaatgaggtactatatataaaactctcggtgtagcgcttgacatattctaactctcccacttcagtgacagtttttactagtggtattaacaatgagttccagggtgggaccctccttgtatgtcatctccatgtgattcctaaggaagtttgttttctggggagctggggaagttgtacaatctttgctaagaaaaccaagttgcctcctgccacccacatctcaccactgccctagagataccccagatctcttgtggtcttgtttcccagtgtgaactgctgcaatcagtggccaaggctgcaagccaggcagggaaggggactgtgcaggagacagaagatgaagaaatcgggaatccggcacagcagcgacaggagctcattgactcctccccaagggccagctcgggaagctggagaggcctgtcattaactctctttattatctacattttctgcctcactggctcatctgaggctgcaaatgggactcactccttgcacgaaccttgcttcattggattctggaactgggaggaactgaatcacggaaaacatttatcaacttgggggttaaatgtgggagatagggaactgggtgtgcacataatatggagtttgtccttggaacttatcctaaaaggatcatggtagtttctaccctaccatggcttcttctgaacccagagtctcctaccactgccatttggaggatcagccatgccctttctagccagattcatatagctcacctcttgcattttaagaactgtgtctatatggtagtctcctacaagaacaggagcagtgtggcatgggtttatagatagtcatgtgctgcttacaactcatgagaccttagactctctgagcttcagtctctttctctgtaaaatggggatgattacatgagccttgaagtgctgggtaaggattaataatatcatccttctttattaagcatttaccagactgtaagtgcttgaacatgagctatctaaatccaattctcagaacaataggtaaatactattatcatccccattctgcagatgaggaagctgaaacacaggttaaataacttgcccaagataacacatctctctcctaaccttcctgcaggaaactcatctattcccatgacttacaagatcatccatagacaacagctcctatgcttattttttcagtcctattctctcttctgaggcccagcctacttgacttgtcaacttggaggtttaacagatctttcaaacccatttctcccaagcagatgaagacactgaggcaacttgttcaaggtcaaacaactagagtcatcaagcccgaatttgaacctggatctctctttatctgcaaaggttacactgctgagcacattctatctctctatgagttggtactctcttcaaaatatccctgtcagtcagacatagtggtgcatgcctgtattcccagttattcaaggggctgaagcaggagagtcacttgggcccaggaattcaaggctgcagcaagctatgattgtgcccatgaatagccattgcactctagcctgagcaacatagcaagatgccatctttatttttactttaaaaataaaaataagtttaaaaataaagaaataaaagaagacccttttccattctgtagctcataccctaagtcatatctaccagactgctgtgatactcactaaaccatgccaactgctctctcccccaagctaaagaggccctgagcaccagcctcaggatgtgccaagaaagaagctatccataaggacagagggaagccccaaagagggctcatcagagaaagtcatggggaagaagagctgtgaagccatcttatctccttccatcaaaagcccctgttctggctgggtgcggtggctcacgcctgtaatcccagcactttgggaggctgaggcaggcagatcacgaggtcaggagatcaagaccatcctggctaacatggtgaaaccccgctaacacggtgaaaccctgtctctactaaaaatacaaaaaaagtagccaggtgtggtggcacgtgcctgtcatcccagctactcgggaggctgaggcaggagaattgcttgaacccgggagacggaggttgcagtcagctgagattgtgccactggactccaccctgggtgacagagcgagactctatttcaaaaaaaaaaaaaaaaaaaaaaagccccgttctgtagctcaggaattatgtccttgaggatttaaatgtgtgtgtgttggggggagggggaagggtgccttagggaggatctctgagcttcccccaaagagttacagtgtatggcaactcttatttatcaaggctgtgtaagccttcctccatctgccaatcatctaccttcttcccatccagtgttaatctccctagtagcacatgctctgtcatctccttgtacactgagtgttatcttcagtgtgaaacacaggctcaggcactcagatcaggctatgctacaaagtaatgaagcacttcttatttccaaagaaaaatagatggagaaaactcatccttaattaataacatgtggcaagtatctgccctgtgtgaccacatggggcctccatgagttccctgtatggtctagagagaaaaggggattttcccaaggtcatgaaaagttgacagcaaagctggagcttgactttgggggctttctgattattatctttacctcagatcagccaaacacacaaggagtttcctgagatagccttgcatgtgacaatctcagaggtccattttcaagcattcaagtcttgccccctcctcaggaatcagccacagtatgactatgggcagcaagtcagacctcaggtcttccccaaatagcccattttttgcctcatggaagcaaaccatgccctagctggaaaatccaaaaaagtgttttaagctaaaaaatgaaacccagtactctccttttgcaaacataggggcatgtaaaccagtaagtttaagaagccaactcatactaaaaattcaaaaagatactggatactcaaggtgaaaggaggagatcagaaaggagtgaaatggaaggaaagttaagctgggatctacttcctcccaaggttacagacattgctatcagctggcagtgcaacttcaggctagttattacacctcattcatactctgtttcctcatttgtaatatggggaatctgatagcaactatgtcataagggtggtgggtgggctaaatgagttgagttctggcatataagtaacttagcatggagcacaacaaatgcttactttgtgtttgtcgtcattgcttccaagttccttctttggtctctattggtgtggagtatctcattgcttttttttttcacagattttcattctgtcacttaggctggagtgcagtggctcaatcatagctcactgcagccttgaatttctgggctcaagagatcctccttcctcagtctgccaagtatctaagaccacaggtatgcaccactatgcccagctaagtttaaacaaattttaatttatttttatgctattttatttattgtgtagacagggtcttgccctgtcaccctgggctggagtgcagtggcaggatcttggctcactacagcctcaatctcccaggctcaaatgatcctcctgcctcagctccccagtagctgagactacaggcatgcactaccatgccccgctaatttttgtactttttgtagggatggggttttgtcatgttgcccaggctggtctcatctgccttaactcaagcactccttctgcctcagcctctcaaaatgctgggattaccgttgtgagccatcatgcctggccacatatccttctttatctaaggtcagaagaacctttaatttcaattaaccttccttggtcaaatagtcttttcttcaaccactggccaagctgaaagtagagactaaaaaataccacaccattatttggccagcaaagaaactctccctcccctaccatcaccatttcctctccttttccttttgcctcttccccctttccctccctttctcctccctcccttaccttctcctttcctcctttcttccctgcttgctttggcttaatgaaaggcctcacaggacgctgtccgtggtgctgacttgtttttctgtcttgttcaaactctgtatgcaaatgaaaagacaacacagctattgaatgttgaagctggggacattccccaagctaatctctgtgcctgtggtgtggccacggctctggccattatctctggccacagtgccccggagatgctgatgctgacctggaccagaggtgccagcctgggcactgccagtccccacagccattgactagagccccagggcacaggcagctagcaacttatctgggtgccccagggactgctattggcaaagtgatggccccacagggaccaaatgtgaagctaaagcaggatacgcaggtcggagataaggccaagaacagattccctttagcgctcaagtgctgtttgtcagaaattgacagccccacggccctggccggtgacaggcacagggtgataacaataccatatgatcagcatcattggaggacaggctgtcactggctcccagagataaggaaacaatgggcgacccctctgcctagggaaaggcctgcatggagcccccagggcaaagcagcaagatctaaagtgtgtctctgacccctggcacctcaccagcaccccctcctcccagcaggcccccagagctccttcctgtcacccagggacccgtggcctccattgtgcacccactattctgacccctgttctctggagttaatcatgttatctctagagcacaggtgttagtggatgataacagacaagcagttccctccccagctccctgcaccacagacgctgctaagggaatggagtgggagaacagagctttctcgaggtggtttatgcaggccatggattcagcactaacagcctctctccagcactggattcttgagaaataaaaaggttgggtgtggaggggctcccacattttctagtgtcttcccattccaccccactggagcaaagctgttgaccctacacttggggacatattttgggatgggttccactgccctggcttggctatatcccttcccccactgctgcgcaacctttccctaccatagccccaatagccatgaaatggggactcagcacacctaggtcctagttctttccctgaccccagcttgatgaatgatttagggatcatagtcaagtcacttcactccctggcctcagtttcttcaactgtaagttggggctactcatctgtaactatcagatctgccaggtggtatgaagttccagtgagataaatatatgtgagggctgggcggtgggagatctgagatttaccccccactaaccaggcccactgagtacagtgtggagcactgctgggtctcagcttggaggtctgctctgcctgactccccaggtggcaagatcatccccccgttcccctcctcttctatgcttaggctgtgatttctcatgggctcacctctcataccctcctgttttctttctctcatgtctgtctctcaactggttcttgttcttgcctttttttctgatcttttacgtatatctgcaaacctcactctgcttcctcatttgttgctgatgcagaaagaatgcaaaggattatttatttagcttgtattttggcaccattatggatgactttgatgttgctttggacaaccatccagcaccctggcttcgtagttttttttgaccctgtcaactccaatgacctccacccccttaccccttcagttcgtgcctgcggacacattctagactttgtcatcacccacaacttacccgtctcgaaaatattaaactttctggtgacagctcctgtgttcttcattctctaattccactctgccttctctttagcatcactaagatctctagttctttctgtctccatttcctaccaaaatgcttgccctttgcttggtctgtttcttttctaactggccaagatcccctgactcatgtcaaatatgtccctgcccatgcgtcctttgtccctctgctgccctcatttatttacttcattcattcactcattcattcattcatccaatacatttttagggctggtcaagggaatgggtggtatttatacaatttttttttttgagacagtgttgctctatcacccaggctagagtgcagcaatgcaatcacggctcactgcagcctcgacctcctgggctcaagctatcctcccacctcagcctcctgagtagctgggactataggtatgcaccaccatgtccagctaattaaaaaaaattcttttggtagagacaggatctcactgtgttgcccaggctaatctcaaactcctggcctcaagtgatcctcccacctcagcctcccaaagtgctgggattacaggcatgagccattgtgcccagccccagcacatttttattgtgcatctactatgtgtcaggcacagtgctaggatctagagagcctatggtaagcaaaatagataatagttatccccttgagctctagaattcaatccaattgaattcactcttggctattatatttggggtgctgatggttccctgtgaatttctggtttctaacattctctggaccctcattgttactgtccaatcttttatttttttatttgtttgtttttgttttttgctgtccagtcttttaaatgggtgctacattgggtcagtagttctagacattttagtgtcctgacacatttacaatcccccctttatttttgagacagggtcttgctttgttgtgatcctctcacctcggggcatcccaaagtgctgggattacagacatgagctactgtacctggcctacaaatcttattgaagttataggcctctccccagaagagtgtccttgcatatacattccactgacaattttagaagtccatgtactccataagcccagtcaagagcccataaattagacaaattctgcaaacatattcaactttttggcctaagaattactaatctcatcttgccttcaacccatacaccaacatttttcacatcaggggcacagagggtaaggggcagagttcgggagctcaattgtggaaacagagatatgaatgaagatgaggcaggtcttgttcattctctctaaggtgtataatagcattaaaaaatctttcttccttagtcacttcccaagagtgttgaattggaaaatgtgggtgtattatcttctgctgggcaaaaaaaaaaaacaaaaacaaaagcaaaaaacactcaaaacctagtggcttaaaacaacaataaatatttattacctctcacagtttctataagttgtgagttcaagagtggcttagctgtatggttctgctttgggtctctcataagtttgcagtcaagatgtcagctgtcttctgaaggcctgcctgggactgagggtctgctttgaaggtggcttacttacctggatagcaaattggttctggatgttgtcaaaaggcctcaatccctcctcacatggatttcactctagggcacctgagtgtcctcacaacatggtgactggcttcccccaaagcaagcgatccaagagagagcaaggtagaaactgcaatatcatttatgagatagctttgggagtcacatctcattatttctacaatgtctcataagctttttttttcttcttaagcggcaggatattgctgtgttgcccctactggacagcagtggctccatcatagcttattgtaacctcaagctcctggcctcaagtgatcctcctgcctcagcctcctgagtagctgggactacaggtgcacaccaccatgcctggataattttttctttctttcttttttattgttggtagagatgggggtcttgctatgttgcacaggtgggtcttgaactcctggcctcaagcaatcctcctgcctcagcctcccaaagtgcagggattacaggcgtgagccactgtactcagccatatcctgttgcttacacaggtcagtcctggtcagtgtgaaaggggactacccaaaggcatagataccaggagaggagaatcactggggccatcttggacaccggctacaattatgggagatattcccagtggggaaaccgtgatatttgtgtataagttattcataagttgagactttctcagtcacctctgcctatgcttttgagggcatctattagtcttcaattgttcattttactttgcattccaacacacaaggttagctagcaaagcatatttttcttctgttacaagtgcaggtgtgtaagttatcactacattgggagtaatgaaaacagccatcctttatgtagcagttactaagtgccgggcactctcataagcactttatatatatattaattcatttagccattaaagaaccctatgaggtagaagttatccttgcccccattttacagatgagaaaacggagacacacaaaagcaaagtaacttctgcaatgccccacagctagcaagtgccaaaggagggattgaaccatagcagtctagagagtctgtgctcttaatcaccactcttgaccaccagcagaaggggttgtagatggtgtggaatgtagacgtacccaagttctcctgggggcattcagagagagtcagtgactgagagccagagagtgtcgacatcaagggcagagcatgggaaggagatgagaagaggcaaactaagaggcaggaaaagaagcaggagatgggtgtgtgctggaagtcagatgtgagaggagcaaatgtgggcaagagcgagcggcccaggccacagagtcggtgagcagaatgaggatgacatcggaggtcctggatgaagcagtttggtggagtgacgtgtggcagccaggttaaagtgggttggaagtggatgggaggtgaagtggcaggtggaccactcttgggacagcccagctgtgaatgatgggggaggcatggggtgagtggagggagagagaaagggccccccagccagcaggagatggggatccaggagagatcccagcctgaacccaggcctctcacccaggccaagccgagcagaatctgttcttccgagaaggaagctcccatcacagtaagtgccaaatgaggcctgaagacgcaaatatttgttcggcttctgcccttcttgttcaaatagggcattctctttggggatggaggttggctgctgcagcgaagaagtgagaagtcagtaagggtgggagggtgtaaaggaggagcaagtgctctgggggccactaatgaattccccaggctcctgagccactggaatccattagctcatgaaagcagctaaataataccccggctgctttatgagacatctgttcaaataaagcctacctttctcctcaagatcagacttcatcccactccctggtgcccatcctgctctgtctgactgcggctgaatcaggggttgtatgatactgcctctctgcacccccgctacaagactgtgtgttattgtgtgagggtgtgtggttatgccatgaccgtatattactctggagctatgctctgtgtgggtttctttttgccagtgtataggagtccactcatcgactgaattactctgtgtttgtgtgtgtgtacacatatgtgtttgtgacactgtctcgctgtgcagctgtattatgtggtttgtgactgtgttaccctaaggctacatgtctgggatcttgtgttgctctaagagtttctttctgtgctgtgacaatttttgcctgtgtgttatcgtgatacagcacattactgtatgtaatttggtggtccactgtgagaggccacctctgtgtgtgtgtgttcatgtgcacatgttaccgggggaggtccttgtttttagagctcccaaaatggtggtgggccacttccaagatggtggcaagcctcctgttctctgacctggggttcttggcttcccggattccaaggaatggaatcttgggccatgtggtgagtgttatagctctattagaagccgtgggtcacagaagtgaaccgtggaacccagcgactagcgttcagctcaattaggacgaacccaggcacttagccatgcaggaacaatggcgagcctctagcccgatcaggagctctgttttcactctgctaaatcttgcaactgcacactctttctggtccgtgttggttaaggcttgagctgagctttcgcttgccatccaccactgctgtttgccgccctcgcagacccgccgctgacttccacccctctggatcaggcagggtgtccactgtacttctgtccgctgcacttcacagtcaccttccccagctaggcttaggaattcttagtcggcctaagaaatccagctagtcctgtctctcacacacacactgtaaatttatcagtgacttcgcacgtggctatattacgctgtctggtgtacaaaggtacacgtaaatgatgtgcctgtgtgttactctgcaaattgggtattgtgctacacacagtgaagtcatgggacactgtgttttagtgggacactttgttgtgactgcttgtgtgcacagaaggacctaaatctctgacttcccctcccagtggaccaggaccattctgaggagcacctggacagatgtggcgaatgtgaatgatggtatgtaggatgggcaccacttctcaactgttggataaaggtctaagccttaaatctcagaaaggatcagtccagggcagaggcaacacccaagaggcagccagtccagtagctgggcaaaagaaggagcctaggctgggtgtggtggctcacgcctgtaatcctagcactttgggaggccgaggcgggtagaacaaggtcaggcattcgagatcagcctggccaacatagtgaaaccccatatctactaaaaacacaaaaaattagctgggcgtggttgtgggtgcctgtaatcccagctactcaggaggctgaggcaggagaattgcttgaacctgggagacggaggttgcagtgagccgagatggcgccactgcactccagcctgggtgacagtgtgagactctgtctccaaagaaaaaagaagaagaagaagaagaagaagaagacttcagggaagcaaggtggtcagctggtagcatccaagcccaaggaggcaggtggacaggtgggggcaagggcagaacctgggattccagaacctgcaaatccctgctgtgtccatgatgcaggggggttagactagcaacatccacatgcatcagaagcactggggaattttatctaaatggaccacaaccaaagattctgatttactagggctggagcagggccctggggtctacatttataccaagactcctggctagtcaggggacctcactttaagaaacactggatcccaggctccacaaggaaaaggtgagaaacatgaggcacagtaagaatctagagggggaaaggaagaaaacaagagagaaaaaaaggagaaagggaagaggagatggagaaagtgatgtggcgggcatcgttggtgccctgcccatatctcctgagcactggtcactctagtttgcaccctgagtcctatgggttcttcacttgaggactcttggattctctctctctctccctctctctccgcatccccccactggaatcatctgcaaaatcagctattagcactcacattgttgtctcagtgttggcttttcaggaatcttaagacaggcgagggaagaaatccaaaaactcctcagcctgaagcatccagctgaccagcaggagcaacaacaagggtgtggggtggggctgccaggctgctcctcccattggctgtttgagcttcttccccacttcgggaggttgcagctacttattcaggtgatggctctctcagtagacctgcttcctctctggtcttttggatgcctgatcattttaattgattgtcagaagtctccacttccaaagcattgttcttgaggccacaggctgttgccgccatgcctggcagccagcagttccactcaaaggccccttagccccggccaggggaggtaacagctggcctgggcagaatctgccgaaacccccgcccggcaactccagttctggaggcctctttccagtgccatctggatggaattcctctgctcagactgtgtttggagcaatgtcggcatggtcaggtgttgctgctctttgataaacccagcctgtctcccttgggcagccccaccatctgctttgtctatttcctgcaggaatgtactgcatgaataaagacccctctgtggtgggacccagctgcccgaaggtcagcccctgtgaatagagagcctgggctttgttcaggggtcagtttgatgacagcctctgacaagtgcccagcacttcccagtgtataaagcaccattccagcctttcccccagtgctggaaggtggggattttgggtctgacccatgggtccatggatcttcactacaatagcaaatgaatttcattttgaatggtgacccgatgatgggtagctacccagggccccacagtgaggattctgaagctgtctggacccagaagaaaagattgtgaagtgacttgacgcaatgtcctggagcctggagtggggaacggtagcagactgctgatgccctcagccacctccaagttcttctcaggcctgggtggacagtcccagggcctgctagcagctgcccatcttggatcctcacttcatccttctcagcctgaggtcttcctctggtgccatgagagctagtgcagtccactcacagggcaacctggaagtgccagagattttaacaaccccgcccccagggtgagggcaacctcaacctatgagggatggttggtcagtggctaaaggatccaggttctctgccccttgctgggccaattctgaggcacattctgcaatattgctcagagtctccaatgtgattgagccccagttgcccacagcagtgactcgctcattagtgcaccttgactggctatattccccctcccctgcccggtctccctttcctactccctcaccattctttctgccatcacctcacaaacaaaccacctccactcaagtcctggctttggggggaacccaaactagagcaagagtgatggcaaatgtgtccacctcccaccccatagtgggcagtgacagtatttagtagcattgaccttttgccagcactaggaactaaggttgggaaatggggaaatgaggccaatgggtcgggaccatagcctttgtttttttgttgttgttgcttgtttgtttgagatggagtctcgctctctcacccaggctggagtgcagtggtggggtcttggctcattgaaacctctgcctcctgggtttcagtgattctcctgcctcagcctcccgagtagctggaattacaggcacctgccaccacacccggctaatctttctatttttagtagagatggggtttcaccatattagtcgggctggtctcaaacttttgacctcaagtgatccacccaccttggccccccaaagtgctgggattataggcgtgagccaccatgctgggacagggccatagcctttgaaaggccccatctgctggggctggtggacacccacatcggtagcatcaggaacatactgtgtagtacagagcagggggctgtggagaaggatgcacgtgcctccacatggagaggccaacggaggctttctggaggggatcaagtgggctgagacttactttggatgggaatcagtccttggcctttgtgtccatgaagtgtcagctcttcttccaggagggctgtcatcacctcctacttcctggactggatggctttccccttgcattggctgctacggcacctgaacctctcttttgtggcaccccatggccagggggctatttgctggattatttgaccaaatgtctagctccctgactagattacaagcttcatgtgggcagggactaggcctggttttgttgacttgtcagttcccagcaccaagtgcacctccctcctgtgtcccctctgccattgctctggccccaacttcattgcctgtcatttggataattgtactagtctcctcactggtctccttgcacctaaaagccaccctgaagggactgctgtgtcagccctgctttcccaacccccagcagctatggtcagtccccctcctctgtgcagaggggccaattctgacccagatcaaaaggtctggggaactccgcttccacccacgggaccagaatgtaagaaatgggattatttcaactgcgtgaattgttcccagacaccccagtaagtcctgacaccttcatcacccactgagccacagccttgccccagtagtgtcccagtgtacaagttggggagctgagtcggagctgcctccttttgagtttccttctccttggatttctcctcctccaggaagctgtgttagatgcctccttggctgcaccaagaaggtagtatttgagtaaaaactgaaggggtgagggagtgagccatgtggatgctggaggagagggttctaggcagggggatagtcagtgccaattcctgaagcaggaagagaaccagaatgacaagtagcagcaagctgggtatgaagagaaagataagaaatgaggtcagagtaggggaggcagatcccacaaggcctggtgggccaccctgaaggtctttggccattgctctgaatgagatgggagccactgaaggtctttgagcaggggaggccaggatctgacccatgtcataacagcctcactccagattctgtattgtgtggagattgcaggaggggttggggcaaaagcagggagtccagactggagacattggccagaattcagctaagagatgctggtgttagtaacatgatgggggtgataatgacatgaactgaccaaaatctagatcacagattcatggagtataaaaagctgactttcccaggcccgtcttttcctgggggcagtctccctttggcccgatgccctggcccaccctatatggtgggttgatggcactgtcactcctgcaaaccctgctcctgtcctcactccaccaccctgctgcatgccctggaggagacttctgggacactgagcccctgcccatcaggcccttccagatctgaagtgtctggccctgtagcagcccagctcccaaattctcacccctcctcttctttaaccttagctgcctgacccccttatggacaggagtccctgctcccctctccggcctgccccaggctccagccacatcaaaaggcttgcagttgcagttgcccaaatgcaccaggtctttcccatctctggaccttgctagaatgcccctccttcaccctttttatctaaacaactccttctatttcctcaagactcaacccaagtgtcatcccttccaagaactcttctgaggccccttcaaattgggacatccctttcccctattctcttagccacaacactttctctggggaactatgtctccctcacataactctacacctaagctacctgaagtgagcccacctccatgaacttgctccagtccgtggctccctatgcctgatgtttagaacacaatgcaactttatcttaccttccagctctatcttccacacatgccttctgccttctccagctcctaccacacttgacatcccccactccttcgccatgagttttcccctttcagtggatgagaagtggcccaggatgttcccagtgacacattagcatgtgccctatgcagaggggcaggatggactttcagatgcctgggggatgacaacgaggcacatgcctgggagtgagatgaggctgtagtgctcttgagctcctagtcagacaggcctggggttgaaactcggtggtgacacctactagctatgtgaccttgggcaagccatttcaactctatgagccttggttttctcctttgtttcgttgttgttgttgttttgttttgtttttgttttttgttttgaggcagaatctcactctgtcacccaggctggagtgcagtgccattatctcagctcactgcaacctccgcctcctgggttcaagcgattctcctgcctcagcctccctagtagctgggattacaggcacacaccaccacacccaactaatttttgtatttttagtagagatggggtcttaccatgttggtcaggctggtctcgaactcctgacctcaaatgatccacccacctcagcctcccaaagtgctgggattacaggagtgagccaccacacccggccagttttctcctttgtaaaatggaatatgaatacctgcgtggcaggggtgtcatgagagcccagtgaaataatgaacacaaaacggttagcacgtgactgacatttcatgaaagcatcaccaaattgccataatcattgtcacgaaacagatcaaacagaaaacctctgccatttttctaaccatagcagtgacaggggaatgtactttttgctcagacctgacagtgcctggcttgtcaggataattcaggatcctccaagacccagctctgggtggttcatgactagtcagttgcagtttgacaattttgtattgaggacctgagtcatagaggtccagggctgatgagacggttgttctctgtggcccaagacagggccatgggagaccttggccttagggttgcagaggaaaagcctccaacttcagcctttctctcaggtgtcctcatcagaacaattctcagtggcagaattttcaggacatcagccttgtccaaaatgcaagttccaaggtgatggaggatgtgagtccagacatccctcaaccagcaatggcagagcagatgggtgttccacacaggcaagggggctcaactgaagacctctggggccagatatatcccattgtcccctttgagctccctgccagttctgctcaggaccactccaggtcttaagtacgtagcagcttcttggggtcctttaattcccctctcaagtccaggccaatcttccaacttttggtgcaggaaggactctgtaagctctggtttcgattgggtaaatttacacctgtatcctatgggtccttgtaagtctctagtttgagattccatatttgcttccaataccagaggtgtcaattaaccctgagcattcatctccaacccagaaggactgaagacagcatgaccagtccatggcattctgtcctcctgtgtccaggggagacgtcactaagtaatcatgatattccctcccactaaggatacactcatcatcagaatccagggctcctgcgagccactgccaaatgattgggaaccctatttgcatttgagcaaatgttttggggcccagatgatagcaatggtgttggtaatggtggtgacagtaatgatggtgacagtgatgatgatcctatttgcagatgaactttgtggtttgaggcttgcaaagtcctgtcagctatatggctccacaactcattcctacaactgtcaaagacaggtaattgtattattcagtattcaggcctctttaggttttaagtaacagagtattttttatctcaatcatgtctacacctgggtcacctctcagggtggggtgggggagggggcagatgattctccaaaataatggattctaggggtacaaaaagcacaaatccacaagagtataattgcccccacctcaccattttatagaagagaaaagtggttgttcagagatgccaggtgccctgcccaaagtcacacagccagtgagtggaaaagccaggactaatacccagggttctgaagctttgagttcaggatgcttttctcatccctagcactgcttctcagaggctaaagcaaagttaccctcgctacctccaagacagcccccacagcagagcattctgagggcgtctttagtaacactggtgaggacctcgatgtggacagatggggcttctactgctgccagttccgtcccaaactggcctgggtacagattcagaggggacagtgggggcagggcaagcagggactctcctctcccagtcatcagccggcccaggcccaggcgcaagctgtcctgcgtcctcccagctaggcaacagcaggagtccaaacaggcaattaattactgcctggctgctgccggctctcctcctcccttgctcagccaagtgtgtaatgaaatggaaccaaaacagactcccctgcccagagggaccctggcatgcccaacagaggatgagctccagggaagcagggaaggggcctgagacgcagaggtgagtttattaacacaatgagcttccctgaacccttctccctcacctttccctgcctgttggctgcaaaagcagtctttacagacagcactgtgatcccaagtgatccctccctggcagcctgagtatagtggtattgttggtattaatcttataatattaataacagtgaagtaggcagtgtcctacatactgtacaggcattacctctttcttttttttttttttgaaatggagtcttgctctgttgcccaggctggagtgcagtggtgcgatctcggctcactgcaacctccgcctcccaggttcaagcaattttcctgcctcagcctcctgtgtagctgggattataggcgcacaccaccatacctggctaatttttgtatttttagtacacatggggtttcaccatattggccaagctggtcttgaactcctgaccttgtgatccgcccaccttggcctttcaaagtgctgagattacaggcatgagccaccacgcccggccggcattatctcttcaaatcctcaaatcaggctttgatgtactttttatgcctatgttaccaatgagaaaggcggagacacagagaggtggaatgggccctaagggggtgatgtaatgtagtggtcagagcacaggctctggaaccagatagaaccatttaggtcacttactagccatttggcctaggcaagttacttaacttccctgtgactcagtttcctcctctgcaaagtggtgctgacggttgtatctaccttgtaaggtcactaggacagtgtttgacgtgaagcccgatccatggtagctctgtggcttcagagggtaggtgctgttatccttgttctactattttacattaaaatagtaaatgattcagtgcataaagtacaccctatgcacatgacaaacatcacaagtgactaagaaacttttcatccacaaaatttcaggcccattctgaatcctctcactctggcttctgcatgccttgccaggtagcaagttcagctgggcatcatcttctgttctttgtattaaggacgtaatgggagtttttgtttgttcctggaagagccatggacattctgatggtgaatattcttttataaaacttagacacacttccctgcaagagatccttaggtgttccccaacctagttccaaaaatcactgcccctagggccgggcggggtggctcacccctgtaatcccagcactttgggaggctgaggcgggtgagaaaccaggagtttgagaccagcctggccaacatggggaaatcctgcctctactaaaaatacaaaaattagccggatgtggtggtaggcacctgtaatcccagctactcgggagactgaagcaagagaattgcttgaacctgggaggcagaggttgcagtgagctgagatcgtgccactgcactccagcctgggtgacagagtaagactctgtctctaaatataaaataaaataaaatagaatagaatagaatagaatagaatagaatagaatagaatagaatagaatagaatagaatagaatagaataaaataaataaaataaaaaaaatcactgccccagactgggggaaattgatcctccctagacatccagatgggcaggctggccagtgtggggccaaaaggaagaaaaaaaatccaactgagactaacggcatcgaaaaggcaaggtacagacctaaaatgagtcaggaactgccccctcactcattcatgccccctgtctccccacagcctctgagccctggggaaggggtagctgggttaatttatttctgtagcaccagcacctggcaaagggcccagcacaaagcaggagattggtgaatgctgaataaaggaaccagcaaatgaatgaatgaatggcatagctatttggggaaagatatagagtataaagctatagagaaaagaagaaaggagaaatacagtgctgtccattctcagctccttacaagtgctgaataatctctacattctgctgtgaaagatctagaaagacatattgctaagtgaaaaaaagagctaagtatacaacagggtgtggaatcctttatctttgtgttaaaaaacagaacaataagaatatacatgtgtatttgcttatatattaatagttgtacttgtggtataggcagataagaggcaacttaagaaaccagtcactggcctgtaatcccagcactttgggaggctgagatgggtggaccacctgaggtcaggagttcaagaccagcctggccaacatgatgaaaccccatctctactaaaaatacaaaaaattagccaggcatggtggaatgcagctgtaatctcagctactcaggaggctgaggcaggagaatccttgaacccaggagacagaggttgcagtgagccaagatcatgcactgcactccagcctgggtgacaagagcgaaactccgtctcaacaataacaacaacaacaacaaaaaccagtcactgtgttagggacagtcagaacatggggggatgggaaagaggagttacagggagacttcaccctatatgccctttatatattttgtaaatttctaaatcatgtgaagttaaaaaataaatcaagaaaaggaaaacaaaaaaatagaaaatttctgctccaagaaaatgttgagtaagatctacctggcttaatggctgaggagggaagggagcgtgcagtgaatacctagttacagcccatcttctcaaggagtcagtataattaagggcttggagttctccaacctattgatcttggaccagaaaacattagatgaattcccaggggcctcgagctttccgaagttgtttctctaaattccacatctctcttgttgatagccggtagcctctgaacgctcccacgatggctgaggggtacagttggtgtgggctattgggactagagacgttaggaaagacctcatagaggggctggagactaccctggggtggaaggggaagagaagcctaaaggcctggatacaaaaggcaaaggaggcaacaaaaacaacaacaacaaacaaacaaaaaaaaaaagaaagaaagaaaagaaaaagcaatattgtccctgctttctccttgtcatctctccctaagacccacctcctgagaaacatcacaatatccaatatcttgtagagagacttctataagccatgacattggggaaggcgtaatcactctgacatcaggattacatttgtaattgacaaatgtgggctgggtgcggtggctcacgcctgtaatcccagcactttgggaggccaaggctggcggatcacttgaggtcaagagttcgagaccagcctggccaacatggtaaaaccccgtctctagtaaaaaactacaaaaaaaaaaaaaaaaaaaaaaaaaaaaaattagctgggcgtagtggtgcatgcctataatcccagctacttgggaggctgaggcaggagaatcacttgaacctgggaagtggaggttgcagtgagcccacataatgccactgcactccagcctgggtgacagagcaagactccatctcaaaaataaataaataaagacagacaaatgcggaaatagcacagatgctttcagggagcagtggacgctgagagccccagcacaatgggctgggaggaccggggtagggggaagtctacagaactgcacctagggtcagagttgattctggagccaaaggaaggagccagcagctggatgtggctggcccaactctgaggggcttgggtgctgtccaggcacaagaatatctccttgtctttgggatctagactcagagatcccacagtaggaggcctgtgtcctgtagagggacatcctctataggaagtctttgatgagcacattcatttggcttttacacctgaaaggcctcctaaccttttgatgaccttcgtgttgatagacaaagcagcccaggctgtgagtccccaagaagaaaaccccagccctggtctgcagctgcaaggatcaagggcagagggaggtctccagcaggctgtacaaagctcaaataattttgagcactgccctggagcctggtgacaggctggtccaggccatggcctcctgtgccatcaaatgcccttttcttaacaaggtttcctcatgctaggaacagacacttttctttggcctgacctctctcaggggctcctgccttgcgtacccacctgtgagtaccaccatccttttaggctgaatatggtcaatgttgataataataagtataccaacagcaataacaatgttatcaaaattgccatttactgtgtttactaaaaggcataggactttacccacattatctcatttaatcctcacaacaaccctatgaggaatgtactattattgacccattttatagactgagaaaagggcacagagaggtaaaataacttctcctgggtctcacagccagcagaggtagtgctgggattcaaatcaaagcagtctgaccctaggatgggttccattaatggcgatgtgacaccaagctcttgttggctttcttccccagtcggcctttcctcccaaactccctgcatcagatgtggcttctctgggatccctgtcattggctgtggaacctcagaatcacctctgatacgtagtttggctttggtgacagacagatatgggtttgagtcttgactctggctcttgttgctgtgtggcctggaggaaggtgatcctgctctctgtttcttggtctccaggtgtgtgaaatgatctggcaatatctggtgggcttctgtcattgtctgtccagtgcctgtgcttactctgagaactctcttctcatccccatccacagggccatcattgggttgccacagtcttatatgacattgacactgacattgactctgactataagactgtggcaacccagcaattgcatggttttttgtttttgttcttgagatggagtctcactctattgcccaggctggagcacagtggcgcaatctcagctcactgcaacctccatcccctaggttcaagcaattctcctgcctcagcctcctgagtagctgggattacaggcatgtgccagcatacccagctaattttttgtgtttttagtagagatggggtttcaccatattggccaggctggtctcgaactcctgacctcaggtgatccacccaccttagcctcccaaggtgctgggattacaggtgtgagccaccacgcccagccaatgattccatatttattggagttggtcggtgggtgggggtgcggtgcttgatttgagctggccacagtccttccccaggacttttcaagccaagcttatgacaaacagctagttccactccagcagtaataactatgagatgggaagcttggaagcggttagcatcatgtttacttcaatatggaagaagttcacagcagaagaaaagatgacatgctgagagcacagaaatgagaagagaggggtctctggtcctggctgtcctgaggccatgctcctgaggtctgcccctcccataattacctgagaccacagcattcttccagtaatgccctgttgaacctaagctgaggttgagaatacatgaggggcacttagcacattagatggaaaaagtaagccctcaataagtggtaactattatgactatttttttttttgaggcagtgtctctctgttgcccaggctagagtgcagtggtgctatctcagctcactgcagcctccacctcccgggttcaagcgattctcctgtctcagcctcccacgtagctaggactacaggcgcccgccaccatgcctgactaattttgtattttcagtagagacagggtttcgccatgttggccaggctggtctcaagctcctgacctcaggtgatccacccgcctcggcctcccaaagtgctgggattacaggcatgagccaccgtgcctggcctatgatgactattattaagacagcacaagcctgggcaacatggcgagacacccacctccacaaaaaatgttttaaaaattagccaggtgtggggcggacgcctgtggtctcagctatttgagaggttgaggtgagaggatcgcttgagcccgggaggttgaagctgcagtgattgtgattgtgccactgcactccagcctaggtgacagagcgagaccctgtctcaaaagaacagaagagcacagactcagctcaaattcacacctttagaggcagtcgatggaaggagagaaggttaaattctattttctgtatacaccactgtgagctgtggggagtccaggaagcctcctcgggaggagcttgagaggagggtggaagacatcttggcaggggctggaatgaggagacaggtcttgctgaagcaaagagctggacagtttgaggactcagccccgcctcccctggtcaaggcccttagaggcatctctatctgttccttgctgtcagcacagtggtttgtccacaggcctgtggacagcctcctttatagaagcctcttgctgagcaccaggatagaaggatgagaaagacgtcagccatacccgcatggatgtgcaacatgccagggcaaagcacagagggtggcaggaagacttaggaggggcatacccaaaacttggggaatcgaagagggctttctggagggaatgacatctaagcagtgacctaggaatgaatgatgatactagctaatatccatgaaggacagattgcatgtgaggtgttttagatgtattatcaccttgaatgtaatactctccgccaccttgagagggaggactgattatgcccactgagcagattaggtaactgaggctctgctaggtgaagtgtttcctggtcacacagctacaaagcggtggagcttagatttgagttcagctctgtctactataaagtgtgttctggggccgggcgtggtggctcgtgcctgtaatcccagcactttgggaggccgaggcgggcagatcacgaggtcaggatatcgagaccatcctggctaacatggtgaaaccccgtctctactaaaaatacaaaaaaattagccgggtgtggtggcgggcgcctgtagtcccagctacttgggaggctgagacaggagaatggcgtgaaccaggaagcagtgagctgagatcatgccactgcactccagcctgggtgacagagcaagactccgtctcaaaataaataaataaataaataaataaataaataaataaataaataaagtgtgttctgaaccacagaaatgagagtaaatgagagtcagggtgggaagcagatcaacccctgcagctggaactaaggagatctagttgagttgctggataggaggctactgaagcaggcaggggctgggacacatgaggccttgcaggctgagggtggggggagtttgtgcttcatcttgggagcagctggatgacggaaaaggccagggctggctctagaactctacaaggtaagcatcctgcccacagatgcagactgaaatgctagtgcatgagcctgtggcccatccgccctgggtgacaggctgcctcctgtgtctcacctgcctgttgcagcccccctcttgtccaggcactggagagaaggagcccaaggactcaggccctcttcatctggagcgaggagcaagctgaggattctcagccaatcaccaagctgtccctaaatgagccataatcacccctgattgctcctttgtcaggccggctctcagagccacttccatctgaggctgtggggaggggcccttcagaccaacgtgcactgctggtttcctattttagaataaacatgtggggggcggggggctgggcacctcctgagctctcagagatccaaaaggcaggcacagatgaatgtgggggtgaacagaaccagtccccacagtgggcaggagtttacagctggtgagccacttctctggcccttggggccagatcatatccctatttgatgaatgaataacaggctcagagagggattagtgtattcgatcacagagtgcagacaatggagccaaaggacctttcattcattcattcactcgccaaatatgtattgagcacctgctatgtgtcaggcactgtgctgggtgttcaatataaacccagaccttttccgatcatgacaacaataacaatagccagaggttattgagcacttactaagtgccaggtgcttcactacctacattccatgtgatgtctcgtcagtcctcccaccagcactgtgaagtggagtgatgcaggcatgccaatggggcaggaagggtttctctctgtctccatcccaaaggttggcatatgccaaaggtgactcacaaacagtggcatttgaaggagacaggaactgaagagctgaggggatgagagaaggggtccaaagaggaggggtggcttcaaggtggtgaccacatggtgactgcaggggatcagatcaaagaactcacgctgcagagggcaggaagcccagggagctgattaggtacagccacagattgcactgtattgagagatcctgcttaacgcgagtaaaaccctcctctatgccttcctttgaatgctgtgtgcagctcccagctctgaccagtttaacaatgaatgacccatcccttcttccccccgctggggcacagttctagggtgatcatttttatccccatttaatagatgagtaaactgaagcagagaggccgtgagtcacctgccaagggtcactcaaccagcaatggcagagttgattccagagctgaaccctgaagcaacgtccgcctcaggctggtcctagacccagtggtcatgagtctagcctggggacccctcggtacttggcaggcagtggataaaacaacctcagcccctcactaagaaacagcaagcccctccccctcctgcatctcaccctccccacggcccagctcctctcagagctattaaccaggtcacgctggcttgtcccagtccaatagttcccttaattgcctttttatagcacgtcgtacaactgttcattacgctgtcatatttcccctcgaaggcagcagtgggggagccaaactgaggacggggacccatccaggtggcaggggctgtgtgtggggcaccaatgtgtgaagcttattttctacttggtcagaatgaattaaatgcatgcttctcacccttgagtaatacaggaaccacgtttaaaggggaaaaaagtcacagccccctgtcaacaattgacaaattatctttattacaattttatgaaaatatgtacagacagaaagctagctctacacaattggaaaagcggagacaatataccattgcaacaaaaacaaagcctcaatatcagacatttcaaaagaacacgaataatttaacgtgatggatagtgtgtaggtgaaatgaaatcgcacttgcacagtgaatatggttcagcatttagcccccctctgttcttttgtcataaggcccataacaattaaagcagtatttggtcatccaggagacctagaatccgctggtaggttttttagatataaaataatataatataaaattggccaggcgcggtggctcacgcctgtaatcccagcactttgggaggctgaggcgggtggatcactgcaggtcaggagtttgagaccagcctggccaatatggtgaaactcctctctactaaaaatacaaaaattagctgagtgtggcagtgggtgcctgcaatcccagctactcaggaggctgaggcaggagaatcacttgaagccaggaagtggaggttacagtgagccgagatcgcaccactgcactccagcctgggcaacagagtgactccgtctcaaaataaataaataaataaatataaaataatataatataaaattaaccaattctgagagagagctctcacagcctaggttgagaaacaataaatgtgtcccgggagcctcttttttgagatgtagtcttgctctgttgcccaggctggagtgcagtgatgcaatctcggctcactgcaaagtccacctcccgggttcaagtgattcttatgcctcagcctcctgagtagctgggactataggcacacaccaccaatttttgtatttttagtagagacgggctttcgccacgttggccaggctggtctcaaactcctaacctcaggtgatctgcctgccttggcctcccaaagtgctggaattataggtgtgacccactgcaccagaccaagcctttatcagctgtgcaggtctaagacatcctatggggaagagccatgtgttcttggggctggaaagccaggatacagggcccagaccactgaggccagatctcacccagactttaatgaaatccacaaggtcttccgagagcacctactatgtacctggccctatgcctcccacctccctgtcccaggagttgcctcagtagtcaagagggagacaggggtgcctcagaatagatgtatataccagtcagtgcagggagcattcttgggaactgacacaaagaggtgtttggccacggggagtcagatctggattgcagtgcttctctggagcccagagacccaagccctgccctgcagactcacctagagtgctgaggttataaggacagctctgatcctgggttcgactcctgaatccgccactacctagctgtgagaccatgggcaagtcacttaacctctttacattccagggtcctcacctataaactaaacataaaaccaacccatgctcatggagatagtgagaggcttgtccatgatgttgtgacacagggaaaggaagcacttagcttagaacctagcagagaataagcatttggtaaatgttagtgttgatatctttcccgattccagctctcaacagaatttgaagagaacaaaaatgtctagattgggcttttaggctggaggccatggactcaccatgggtgggcttagggatatgaaaccttgtgcaatattgtgtgtgtgtttctagaagaaggatctgcagcctcaccagatgtccacgggggctgtgacctagaaaaatctttggtcgctgagctaggtcagggctggcagaaccactcagtcttagctcaggctgccatgataaagtgacaaagcctgagtggcttcagcaacagaaacacatcttctaacagttctggaggctggaagtcccagatcatggtccagcaggattggtttctggggagggcttgcttcctagcttgtagacagctgccttctccttgtgtcctcatgtggcagagagagagagagaatgagagtgaaagagagacacagagagagagagagtgaagagagagagaaatcaagagagaggacactctagtgtctcttcttataaggacactgatcctatcagattggcatcccaccatttttacctcatttaactttaatcacttctatagaggcatctccaaatacagtcacattgagggggagggcttcaacatatggatttgggggtcataattcagtccatagcagtcagtgagatagattattctagatctcggtggaggcaggttttgaccagcaaaggctgacccttgaggcttctaactaaagcaaggaccacctgcagctcccctggccccagtgatcatcactcctcccaaccgtcctcttccctgcttatgcccatccaattatccacttctccaagtccattcctgcaggccctgcctgcagcctcctaagatgacagtgggctagtctcaggattgtgagaatttaaggaaacaatcctgagagtgtactttcagcagtgcctggcacacagagagcactcagtaaaggcgagctctgcacctagagagtgtaggaggtcagacacacagcccgtttgcactgctggagcccaggatccctgtcccagggtttgctggaatcagagcccccaacacagctgtctctcccagttataaccagtgacccacagattcctagagacctagaatctgctggtagtttctgagtgttcttgcaaggaatccctgaatctggatgtgcatcccaaggcttagattaacaaaaatcacatctcacacacctatgtaggactgactttcaattacataaaagatgatgtgagcacaaaagacaaatccattcagaagagctacagtattcataattcagacctggattttggctgttgtgtgtttcttcagaggggggaaatggctttgtaacattgacttaattcatctccatgaatgagcatctaatgtgtgctgggaacacagtggggaatacggctgacatgcccctgcttcccagcataactgaagctgtgttctcaggaaagggcaggaaccattggtctaacccaccaagtcaggtccagggcccctccttcagttctaggtagcttctggttttaaaggctgctgagggcaagacctgggtcctcatgtctcccgctctctgaccccttctcagagctgtcagcccagaaagcatgaaccttgaaccccagaagtcatgaaatgcagcctcccataccctgaggcaggacttctctagaccttgtctctgataggacatccagcctctgcctggacacctctggagatgggatgctcattatgtgtgcaaggaaaactgctactacatacacagtcatgaatgtattttaatatgtcttaccctgagctcacaggggcagcacctacatggtcaatggccccacctgatttgtcccattgaagggagaagaatcagggtctttgttccatgcataggctcccacctggctcctcagccttgctgcgcctctcctcccttgtgcccagggacacagcatcaggaaattgggttttgatttggggaaaggtgaacatggctccctccagctataggaaaacctcaccaatgtcccagccccaggatacttgggggtgggagtggtttatgaagccagtgcctgtcccctcagcaggaaaagacttgcaaggctgactttgctctggaaaaggagggctctgagctacaggggagggggagggggctatctgtgatcattcagccccgaaatgatgctcatgatgttggctttccaggccattaattcaagggctccatgcctccccttcccccatggtgctgtctgctctgggagataagcccagttctatttaaccctatttattcccccaaagtgactcccatctctgttagccaggcatttaaccccctgggtactgaaggcatcaaaggcagagagattgagctcatgtgtcaggaaggggtgcgtgcatttcacctgggccctggcttcagggaatccgatccaggtccttcctaatccaaactcctcatctggaagtccttgcttcacaaggcttggtggaagtcctgagagaaggtaggaacctgtgtggccctggcaggagagaccctctgacacccccaggttgggtagcgacagctcctgctctctccccacataccctcccagtccctagtttcttagtcacaagatctgggttctggcatcagcaaaagagaaaggctgtggcatctctgcctcttttgtgtcccactggctggtggctgcattcagcaagccctcttccatctccatctccctgcttggtcctttttacgtcccctgcccctttctgccctttgttctctcctcttttccccttcagtgatcacacaagagtagtcctgactactcgtctcggtgtgtgtgtgtgtgtgtgtgtgtgtgtgtgtgtgatttcttgtgtctgggggcttgtcagtgtgtgtgtgtgtttacctgttcttgcactgctgtgtgtctgagcctgttatccaggtgcctctgcccatgcagagggacccaccagtgtctgtcctgatttctttgtgtggcaggcagtcttagtacaaatcttgcatgtgtctgtctgtgtgctggcctgttcatgacctgtgtgttgctctgtcaatgtattagaatgctctgttcaatctactagaatctctatgttgtcctcatgtttttgtacatctatccatcggcttgtcatgctctgtgtgaatgtatgtgtgtgttgtgcttcaactcaggggaccagtctactgcaaaatcctctcctagggaacccttccagaggagctatttgggagaatttggaggttgatggcttcgccagggcagagcccagctcactaccagcaagggaagtcatcctgttggtctcctgggctcttccctctccctgctcctgacctccctccccttctctccaggtcagcttgcgactgtgaggagcagggacagagagcttcaaagacagaagagcgtacattccaactcactcaacccccagatccaatcgcaggctttttcttgtgcactcccatttccacccccagccccacaacgagaactggctgttgagtatagtcactacaacaatcacaaaataattgctatcacgtattgggcatgcagcacctgttaagcatttcatatatgagatctcattgaattttctcaataattctatgaggccgttattcttattttcacattttagagatgaggaaatggaagctaggagaagtcaaggaagtagtcaatgtcatagaattagtatgtgatggggtagaattattcaataaagtgtgggttgtttgagagtttgccacacctgccttcagcctgggaagaggcatttattacaaacagcaggaaaggagggaaatatgggaattcctttcccaactgctggcatctaattatagccagcgggactagaatctgattttgaatttcatctctttggacaatgaggtggccaaataccaaacgacaaccagggagaaatgatgtaaggacaagacgaggtagtgcagggcaaggcatgctggaaagagccttaggattcctgggggttctagcctggctttaacctggattctgtgtgaccttgggcaggacacttccttgctcaggcctgagttttcttgtctgtaaaactaggataaatgtgaggttctgttgggatgtttgggggaggtttaaacattgcagaaaggaaaattggactcagggctttctaagttccctcctagacccaagaattggagtggggagtataggaagagactatgcttgtgtcatcttgacaattcctggaatagccagaacagaatcacgtgcacaggaagggctgtgaaaaggttcactgaatgaaggaataaatgaccccatctctcactgatgaaaaaacgtcacagcccactttagactcacttgtcagagaaggcatcagtggccatcctaaggtctgggtgtaatgctgtggaggaggcactggggaatcctacaaagacccagcctctgcccagatcatctcctgtgggccaaagaatttcaccagaaacagaaggggagaggatggcaattaggatgtggagatctttgtctataggaatctgtagggaaaattctctctctctgtctttcctgtatctgagaattggggtgggccgaggctctccgtatagggcaaatttcggatgggggatcgcttctatttagaagcctccttggaggagaggatctctgtgtttggaggaagaatctctttcctgtctttgttctgggtcctgtcatgacttggagtgtctgtatttggaggacggttctatagaggggtctttttttgttttgttttttgttttgctttgttttgttttgttttttggtcttagtagctggaggctaagaagaggatttctgtcttggtttccaccaggcaggagctaggggctttccagagcttctggggaaattaagggggtacctggggagaggttaggagcatctctgtccaatgtggtggaggttccctatctggagagaagcctcctccgggagactgggaggggcttgggatgggaggaggtggcaggaggcgggagggtgtagagagggaagcctgtcttgtcctggcagctccaactctctggccaaagccctcgggccgccctacttgtgcgctgacgtgagctaatctagaaatactgcagagaaagagtggctggggttcccagggagaaagggcctcgagagaggggagatggggagctgcttccttttttgtttccttcggtttttccgtccgcccccgcccccacttccagtcacagccgctacttctccattcaggctgggactgccaggtggagccctgcggtttactgctcaggaggagcccggccaggacatcagctggggacttacgcagggacccattcagagcagcggaccctcacggagactactacaaagggactaacacaggcacgaacgcaggcaaccccattcgggaacacatacgtaatccaacacactagctctggcacacacactggaatgcgcgcaaaaccacacagacacagaacacacgcggttaccaaacctcattctcagaggccacactgatccaacctcaagcagagtctgatacagcatcggtctttgtctctgggtctctcccttactcgcgctcacacacccgtaccccaatcaacacaaacagcccaagctttcacagcctggaggcggccgtcggagcagggccccagcgcaccgcgagcctctgcttcctccgccttgcagcgccgcgagcccttctttcctccgcgcctggccccgtctgcgcccctctcggcgtgggcattcgcagacccgctaggaggctgacgagaggtgtcctcatagagtcctgccttcttccagacccccaaacgaaaagaaagagaaaagccaacctttcgcctccattctgcacgcatttggagagcggctggtggcgagcgatccgcacaatcgcttccctcgcggcgtccctggacgggcggagagaacccgggtgactgagcctgaggctgagcttccttgggagcgatccatgccagccacttctaccttcaagggggactcgcggccgggtttacgcgcgaaggatgggtgccagggaaactgacttatagacgacccgctccgcgagagactgacaactcagtcctgcgggctttcggggcgcccagaccagtccttagccagaggatctggggctgcacagctcccggaccctggagggggtggtccgggggtgggagactgcgagcatcagcccacgccggccccctcccaccctgcggcggcgaggtgggaagggccaggatgcgagcttagcacctcccctagaaatgcagcacttcgcccccccacctcccctgccctcggcgctccctctttcacgcgctccctcccgcctccttcccaagggcgcccttcttctgcccccagctcacgtctgaatccctcggcgccccctttctcttctcctagccccttcctcacgtcccctgcctccgggtatttcctctctccaatcccccacccccgcaccgcctgattccgaggggcgggagcgcattgggctgcgcacgggtgggggcgccgcgccagcttcgcgtagctgctctgacgccgctgccgccgccgccgccgccgccgccctccgcagcccagctcgcgccccgcggcagctccgcagtgcactagccaccaccgccgccgccgccgctccgccagacctgctgccagcttgcccggtccagccctgagagagcctcgaacgccagctgcgagggtcatgagccagagagccccggggcgccgcgcggagagcaagcggagatagcgactttgcgccccccagccctcgccttcttgcatcgcgttccccgcatcctcgggtccttctgtcctttccgctgtccccaccgccgccatggccaccttgctccgcagcaagctgtccaacgtggccacgtccgtgtccaacaagtcccaggccaagatgagcggcatgttcgccaggatgggttttcaggcggccacggatgaggaggcggtgggcttcgcgcattgcgacgacctcgactttgagcaccgccagggcctgcagatggacatcctgaaagccgagggagagccctgcggggacgagggcgctgaagcgcccgtcgagggagacatccattatcagcgaggcagcggagctcctctgccgccctccggctccaaggaccaggtgggaggtggtggcgaattcgggggccacgacaagcccaaaatcacggcgtgggaggcaggctggaacgtgaccaacgccatccaggtaagcgcgggattcccagttctgcctgtcctcccccctcccagctcagcgtgccgggctctgcccccgacagtcgcccggtgatctcggcctggagaccccctcctgtacccaggaatctccctttctccatccctcccagccctgcgcggggacctacgcccccaggcggtgttttccgccctaacccacgctccctcccaacggcaccagctgcaagaccgctaggctgaagttcggtctgagacacctgtccggagacactgcaaaagtgaaggaaatggggggagggagcaggaagcgatgagaaagaaagaaaatcaggattggagggcacggtttggtcttggactctggaacggattcacagctgcatttttgggaggaaagaagaaggggaaatcgctgaggtcggagtctcctccccccgcacacacgcatagacacgcacacgtatataggcaggcacaccacatgcccacagccccccttcccacgaacaaaggcgcaggcacaggcgcacacgacatgtatctatatatagaccacagtactatccccaaatgcacctgcgtacacccctacagctccacaaacaaaagcatatacctgcacataccaaacacacgaatattcgtttgaacatatgcacacacacatgcacagatgcatgcagacaggaaccagcctgctcccttgggtgcggccctgttggagacatacaggtatacacacacgaaagcacacacatgctcccacacaaacacatttagtccgcaataatccagcattacctgtgcacagactcgcccctctcgcccgaaatcccggctgcaccgcaaagaggcggccagctcctccccgtgtgaccctggcgaagccctctccagaggctaagaatggcccctgctctctaggccctctccccttattcctaaccccccactccccaccaggcggcgcaggactcctacatagggagcaggtttggagtcttggcaacgacctccgagctagcaggggctggcaggccgcagctttctgggccgaaggagacttcagctctaggcaaccccggtcccttacagcttggccccgcggcgtccctggagcgcactatcactggggccacggaaggcaggttttctgggagcagaggcctcccaggggttgttccatgtatcggggtaagcaggactccaccgggccccgaacaccagatggcccgacccaaggcgctttccgctccggggcccggcgagacggccttgctggatcacggacccggggctgctcccgccttcgctgtgccccgcgacttcccggggcgtctttcaaggctccgtttgataggccccaagggaggccagggcaggaggctggaggctcgtaggcctccgggaccctggatttcgttagctcttagtccccgtgtggattctaaaccctacagccctgtccgcctgaccctgaagcttctggttctagactcttgctcggttcggctttctggcctccctggcgccttcccgccaagctcctcctcctgcttgcctccccagcctccacttagtccccttccttaggtctcgccctcgcctcactctaactccagccttgtcctaagactctcaatttccagccctgcttcctcctccccgcgcgctgctccccaagcgtcttcacattgtctctgttcttgcctcccaggggctttgccccaccttcagcccctctccctctctaccctatttccttttcgcctcacaactgcagcctttaacgtttcctcctctggtctgagcctgagacgcccgagttttcctctttagctcccgtgccccattccagccccaccacaaatcccgtgcccactctttccactggcccaggcccagctcactacctttcttagagcccctttccgactacgctcccttctgtcccttctcatctcctcccccaactcctcattctgttcctgtccccagaaaccatcccgaagtatctcccttccctcctgtggcttctccctattctcagccctctcccaccctagccctctcgctatcaccagccattagcgcacctttccttctcagatccgtccatacatccctccctctccatctctggctcgacacccgggctcactattagttcccctacatccaccccgcagcctgctcttaacctctcctccccggcggctcagacccaattctcagtgtccttagcgcccccttcgggccacagcgttaagccacgccccccgggcccctcatccgttgccaagttcgctgagcgtccgcgtctggttgcctctccgccccacagggcatgttcgtgctgggcctaccctacgccatcctgcacggcggctacctggggttgtttctcatcatcttcgccgccgttgtgtgctgctacaccggcaagatcctcatcgcgtgcctgtacgaggagaatgaagacggcgaggtggtgcgcgtgcgggactcgtacgtggccatagccaacgcctgctgcgccccgcgcttcccaacgctgggcggccgagtggtgaacgtagcgcagatcatcgagctggtgatgacgtgcatcctgtacgtggtggtgagtggcaacctcatgtacaacagcttcccggggctgcccgtgtcgcagaagtcctggtccattatcgccacggccgtgctgctgccttgcgccttccttaagaacctcaaggccgtgtccaagttcagtctgctgtgcactctggcccacttcgtcatcaatatcctggtcatagcctactgtctatcgcgggcgcgcgactgggcctgggagaaggtcaagttctacatcgacgtcaagaagttccccatctccattggcatcatcgtgttcagctacacgtctcagatcttcctgccttcgctggagggcaatatgcagcagcccagcgagttccactgcatgatgaactggacgcacatcgcagcctgcgtgctcaagggcctcttcgcgctcgtcgcctacctcacctgggccgacgagaccaaggaggtcatcacggataacctgcccggctccatccgcgccgtggtcaacatctttctggtggccaaggcgctgttgtcctatcctctgccattctttgccgctgtcgaggtgctggagaagtcgctcttccaggaaggcagccgcgcctttttcccggcctgctacagcggcgacgggcgcctgaagtcctgggggctgacgctgcgctgcgcgctcgtcgtcttcacgctgctcatggccatttatgtgccgcacttcgcgctgctcatgggcctcaccggcagcctcacgggcgccggcctctgtttcttgctgcccagcctctttcacctgcgcctgctctggcgcaagctgctgtggcaccaagtcttcttcgacgtcgccatcttcgtcatcggcggcatctgcagcgtgtccggcttcgtgcactccctcgagggcctcatcgaagcctaccgaaccaacgcggaggactagggcgcaagggcgagcccccgccgcgcttctgcgctctctcccttctcccctcaccccgcccccaccagcccagtgcgccctgccgccgcgcttgggaggccaagctttaaacatctctggttcctagtttctgattattcggggatgggggggatgggaggggacagggattcacgatccatcgcgtctgcgtttctgttgtcctttcttttccacaacaccctggttttggggggaggcggggtgcatttgcgggcagggttctctgtccttccaagtggggccccgacactttggttccagtcatcgagggggttgggaagggagggagagggggcgcagctcgcaggcgtggcaacttgaccttgggggaatatttcacatccatccagagctcggaatctacagcgtccagccatttccagcaagagcgcttcccattccggagacgtttcaaccctgcagcgggaaaggctgactgggaaatccattttgggtgggcaatttccttcaacgaagccggaaggcgagaagccgcggcggggccagcttgcctgccggttttcaggaatctaaactctcatcttgtgcaatttatcaggtgtggaactgttctactgtgcgtgtggtgtgctcgtggtgaataagatgaaatgtatatcagaaaaaaatctatctctaatttagagtgcggtacataattatatccgcaaataaagaagagacaaaggcttgcgcggcccggtgtcgggtttgtgtgttcgtaccagccgggatcccctggcgctgggaggcgtgggaactggctcccgccggctgaaaccggagatggtgagcagctgtggttaaagggtccggggagggctctagggagtacaaagattagttggcggcgaggaggctcctcaggtgtgaggaggaagctgaagacggagagtgctgtagcggccccctcagctgccaggtcgaggtttgttcgaatctctcccctgggggcgggtccatctgagaatttggtggaagctctcaacttccaacctcaaaacagagagggacagggggagcttttatgtaccagaactttataaatttgttcaacaaatatttataaacagccaatcagggctggggcagtgttggaaacctggggaaagaaactcagccttgccttccgggagcttacagtctagtgaggtggagacaggcaataaacaaggacaggcaggaatccacaacgtgacttcagattgtgaagagggctacaaaggaagtcagaagtgggctgtgcctttcaccaggtccccagagccacgagccaatctggcccggcaggaggcatctgccacccaggagaaccctgccgtgcaatccaaggtggggtttgcacagccatagcaaagagatctgactctagaatcaacagcctcaagttgtagggtcccagtctccccctatcttgcgcagcctgtctgataaagtgtttgcctgaattacccgaaagatctagtcttttttgtgctgatcccactccaggcgcagcacctgcactgactccaggagggccagtccagggactgttgggaaaggtcagagtcagactttctgggtgggagctgggagtgcaagtccgctgggtgggttccagggtccgctgtcaccacggaggcagaggcttcgttaggaacgacttctccaggtgcgaatggtgcacgggaaagaagccagggagaatgcctaagtagggtgtgtgttgctccccgcccgcttgcaaggggcatgtgagaggctaggtgaagatatgcgtgtggggtggggcaggctgcatcgtgtgttgtgagaaccttggtaagtgtgtgtgcgtgtgtgcgtgtgtgccgagcatccgggtgggcgtgctccctaaagcgcctgcgacagaggtgacctcgcatcaccctggttctgcggccacagacctggagtgggaagggaggagggataggacccggtgtcctcagccatcactgtggctctaatgctttaaaacgggccatctgagaagtccgctaccttcggcctaattccccggggtcactattgtcgcgtgttcaggatccggcactggctgaagggtcctcagtttctcgtcttcccatgaccactgacgtctcccaggcctggggccgaggggtggggtggggagctgattgttcttcccccgccccaactcccaaggtttctcagcgggtccacggaccctggggtgctctccgagtcagtgtgtcgccttcagaaaaatcccggacttctatggtggaagggaaggtgggagcgtcacgctgcaccatctctgtccttcccgtctttaaaaggtcgaaggagacactaggcaggctccggatagcggcgccaactctgcgggctcgcctggatccgctccactaatcctggctccaggttttgtgctcagcttgcagcgtctcttgtcctagggggcgaatcctgagggtggcaggggcgggagaactagcaccctagacgcccaagggaaacccgaaaccctggtcggtaggacaccgatacccggactcgcatccaggctactgagagaaataaggaggaggagtggatggcacccgtctctgcacctctcatctcccccacccatctacccccacctccaccatcactaaagcgtaaaggtagatgttgaaaggaagaagtcccagctttcctcgcagtgggctcgctgtgcaagtccaagagagcagatagttctggcaaggctcattctgggatcggattgagaaggagaggaggaatccgcgtcagccccacagggctcacatcagttcttatggggcaccctagctggacgtgctgcagaccctgtaagctgtccccacctgggtccgcagcataagtgtgtaggtgtacctggccccttgccttggggccaggacctggaaccaccaagacccacgtgcgccggcggaacccaggatcgcgatcgcacggtcccaagaccgccctgcctcgccccctagcggtgagagcgcaaactgccggcccgcaaggacggttctccaccctagtcctaaatgcttcttgtctccccctaccccacctcctgcttagttgataagcattgcttctttctagtgctttatttcaggtcctcaacattacaaaagtttttagtcatttttccccaaacatggatggatgcttattattgaacatgttttgttatatgacaccgtcttatcccagggactgagtgttcctcacttaaagacctggtagggagggagccaaacaggctccatgggggccatccaggaagtggagaggatccaggccttgctattctagaggggacttcagggacaagagccagagagaggctttggtcaaggagggggcaggtccctaggtgggctccatcctcaccatgagtgagggtgtggtagggtactcagtcctggacagccaaggattcattcgttgcacttgtttgacctcagagagccagccttgggtgtccttctcatagctctttcgttttttccttttcaagattatgaagaatttctaatgtatagaaaaggtgaaagaattccacactgaacatacatacacccacacccaccgccgcctagactggatgattaacagtttaaaacactgtatctaccccatacctatccatctatccatccaacagtctacctgtaaaaaaaaaacaacattcaaaagttgcagacatcagtatatttccctcccaaataattattatcatttttgagacagggtctcggtctgtcacccaggctggagtgcagtggtgagaacacagctcactgcaaccttgacctcctgggctcaagtgatcctcccacctcagccccccgagcaactgacaccacaggcaaggcatgtgctaccattttcagctaatttttaaattttttgtagagacagagtctcatcatgttccccaggctggtctcaaactctgggctcaagcaatccccctgccttagcctcccaaagtgctgggattataggcatgaacccctgtgcccagccacccctcccaaatttttaagctttcaggacaagtaacagtgacattcagatagcacagcatcagtacagcactaatctgagccacactggagaccaaggcaaaaaaagcaatatccatcctttctttacctcagatattgttattttgcttacattattttgaacgttatggttcacttttgcattaattttgatttttaaaaaatattgcattaaaattttatttatattgctttctggattttttgcaccctcttaaattttgctaccaaaggaaatgcctcacttgcctcatgctaatcctggtcctggatgtgaggccaggcctgggagatgagctctgcccccccgggagatttggattgagatttttcaagagtctgactatagctggttccacagtgatgctttgggcaccatctctgccagttgtggagtccaggaaggcacagtgagagcagagcctctgaccagggacacccagcagcatggtccagcagagtcacatagcgggtggggtggagggagctttacgattccagaagcttccagcaaccctcttgggggtgggatggaaacagggtgaaaaggctgaggatgctatagaggggttggtggtgtctagaagggaaggcggtgcagctagaagggagagcacaattaaaggaattgttagtgtgattcagttcctgtttcaaggtctggtagttaaacaagatttatttatcaaatatttgttaagcacccactctaggccacacactaggctaaggtctaatgtgtgggaatgcaacaggaaacaagacagacatggcctctctggtagttgtcagtgcccaccctatgttccctagatgcacctaagtttacctgaagctgtggaacatgaaccactgccagtgcctccatctctcctcatctccctgagggctttctaggctaccttgggagcatgacttggaattgtcgggcagctaacagcccctagtgctcaatcaattggcaataaatgcctgtctcctgtcctgtgatgggaccattttaggtctattccacaaggtatcttggagggtccccagcaggattgaacctcaggtgtccacaagctcatcaaagcaatctttatttggcctttcccccttccttttcttcctttccctactttcaaggttcacctcccacataaattgactgcatctgaatctttgtcttagggtctacttttagggaaaggtaaatgaagatcctatattcacagtgcttctaatgtaatatagtggtccccaaatatctttccataggcaggtgccaggctgggtgaatcagaataaaatggggagctttctagaaattcctgctccccacaaaacccctagattcagattcagaaagacctttctcctccttctcttcctcctcctcaaccccctcctcctcttcttcctccttctttcaagttcccaacgtgccactggcttgggaccactaatattgagaaggtttggtcaatgggagggtggtggatggatggatgaatagatggatggattagtaaatgctttgaggtcaagggttggatggttgagccaatgaatagatgaatcagtgagtgaaggaaaaaaatggattatagatgaatggtggaccaataaatggtccatggatgaaaggaagaaaagaaggaaacataaacaggtccatagcaacaaactttagtaaactccacaagggcagagatattctctgtttggcaccctactggatctccactatctaacacagacctgatatacagaatgttcttaataaattatgttcaaataaataatgtattttcagaaaactatcgacacattaatagtactaaagtcacagaaactatgaggtcaaccaggagagtgcatgaacatttaaaaagcaccgggccagtgaccttggataacagcaatatttaaaggtcaggcaggccagatgtggaggctcacgcctgtaatcccagcattttgggaggccaaggagagcggatcacctgaagtcatgagtttgagaccagcctggccaacatggtgtaaccccgtctctactaaaactacaaaaattagccgagcatggtggcgtgtacctgtagtcccagctactcgggaggctgaggcaggaaaatcgcttgaacccaggaggcggaagttgcagtgagccgagatcgcaccactgcattccagcctgggggacaagagtgagactatttctcaaaaaaaaaaaaaaaaaaaaagtcaagcaaatgaagagaaggaggaaaagaatgaggagtcaagattgataaaacatagtctgacagggaggagaagaatataaagagaatgatatcctggaattgaggaaggacaggttgcaagatggagaaaatgataagaatttatttattttctttctctggacacatatcatcttgatttgaggcaggcatggagatgtgatgatatagttcggatgtttgttccctctaaacctcatgttgaaatgtgattcccaatgttggaggtggggcctcgtgagaggtgattggatcatggggaaggatccctcatgaatggcttagcaccatctccttggtgataagtgagttctcactttgagttcacgtgagatctgactgttttgtttaaaagagcatggcaccccacccccatccctcgctcttgctctcaccatgtgaggtacttactcccgcttcgccttctgccatgattgaaaacttcctgaggccccatcagaagtggatgctggcactgtgcttcctgtacagcctgaagaactgtaagccaattaaatctcttttctttataaattacccagcctcaggtattcttttatagtaacacaaatggactaatacatgtgtgtactctttgtttctaaattttggagtagaagaaacacacctagaagcttctcaaagaagagtgagatcagacttggaaacaattgtcatggagcctttactctgaagaggtgttcaaagcgggagagttgaagaatacaagtaagtaaggccgaccaagagaagctgaagagagaggaagctgacgaacaaagatgaggactgaaaagaggctgccgtcggttagattcccccagcaacagacctatttgactgaagtagttcacatgagagctgataccaagaagtaccagtagcacagtggagaagtgagacggggaaggaaaggaagaatgtcaattcaggaaactttatgggtagggaagcacctgtcaataatgggagcttaatccatctgagacgtctgggaggtgagagtttgccactaacagcctctcattgaaataactatcaaagaatagacttcaggaagaaagaaacttaacccacaaggaaggactatgtaggaagcaaatctgtgcctgagcaagtactgcccatagaaaacaatattaacaataaccaattcttgggatctaaggtggaactaaaattttggtaaataacctctaagatgggagggaataattgaagtcttatcttctatggctttctaattcaaatatagggagaaataccattaactttaggcttaatgatgagcaagagtgttactcatacaccaccactatcacaaccatcaatgacaagaacgacaacaaatggatggagaacgtgtaacttccaacctagtagaaggaaaagagcaaataaagaaaacttgcacggatctgggtgcggtggctcatgcctataatcccagcactttgggaggccaaggtgggcggatcatgaggtcaggagttcgagaccagcttggccaacatggtgaaaccccgtctctactaaaaatacaaaaattagccaggtgtggggcatggtggctcacgcctgtaaccctagcactttgggaggccgaggcagacggatcacgaggtcatgagatcgagaccatcctggctaacatggtgaaaccccgtctgtactaaaaatacaaaaaattagccgggtgtggtggcgggcgcctgtagtcccagctactcatgaggctgaggcaggagaatgatgtgaaagtgggaggtggagcttgcatcgcgccactgcactctagcctgggtgacagagtgagactccatctcagagaaaaaaaaaagccaggtgtggtggcgcttgctggttgttccagctacttgggaggctgaggcagaagaatcgcttgaacctgggaggcagaggctgcagtaagccgagatcatgccactgcactccagtgtgggtgacagagcgagactccgtttcaaaaaagaaagaaagaaagagagagagagagagaaagagagaaaaagaaagaaagaaagaaagaaagaaagaaagaaagaaagaaagaagaaagaaaggaaggaaagaaagaaagacaagaaagaaagaaaacatgatcaatgtagaagtcagggaaaaagaaggaaatgaaagaaaaggaaaagaaagaaaaggagcaaaataaaggcccttccagtcaatacagggtagtaaaaataaatgaataagtaataaagataagtggactaaactagccagtcagaagacaatgattctcagattgaaatttgaaagtccatctatacactctttgcaaggtatatatctaaaacaaaagatggagaaagattaaaataaaaagatggaaacatttgccaggctaatactaatcaaaagaaagctgccagcggggcacagtggctcaagcctgtaatcctagcactttgggaggctgaggtgggcggatcacctaagctcgggagtttcagaccagcctgaccaacatagagaaaacccatctctactgaaaatacaaaattagcagggcgtggtggtgcatgcctgtaatcccagctactcaggaggctgaggccaaagaattgcttgaacccgggaggtggaggttgcagtgagccgagatcgcgccattgcactccagcctgggcaacaagagtgaaactccatctcagaacaaacaaacaaacaaacaaacaaaaaatgacaaaatatgccaggatgattattctaaacttggtgtttttaataacacaggttccaaatatagaatgtagagaaatggactaatttacaaacatagtaggagagtttacttattttttattaaaaacaatttttttgagatagtgtctcactctgttgcccccggtggaatgcagtagtgtgatcatagctcattgcagcctcaaattcctggactcaagtgatcctcctgcctcagtctcctgagtggctaggactgcaggtgtgcactgccatgtctggctactttttttatttttatttttgtggaaatggggtctcactatgttgcccaggctggtcttaaactcctggcctcaggctatccttgcacctcaacctcccaaagtatgggattacaggcatgagccaccatgcccaaccaaggagagtttaacatactttctctgatattcaaattaacttgcctttttttccttttgtttgcttttgtttaatatgcctttgcccatacttcaattttttattttttatttttatttattttttttatttttgagatgtagtcttgccctgtcacccaggctggagtgcagtgttacaatctcagctcactgcagcctccacctcccagattcaagctattctcctgcctcagcctcccaagtagctgggattacaggcatgtgccaaaacacccagctaatttttgtactttaaaagagacggggtttcaccatgttggccaggctgatcttgaactcctgacctcaggtgatcctccaatcttggattcccaaagtgctgggattacagccactgcacctggccatacttcaatattttaagttttattttttgtattacatatacacataatttaaagaatcaatgaattctacaagttaactaaaatagcactctgtagccccttcctccaatttctccttccccagaggcaactactttcaattcttacacttgatcccgttttatttttttttgagactgagtttcactcttgttgcccaggctggagtccaatggcgagatctcgactcatcacaacctccacctcctgggttcaagcgattctcctgcctcggcctcctgagtagctgggattacaggcatgtgccaccacgcccggctaattttgtatttttagtagagatgggattctccatgttggtcaggctgctctcaaactcctggcctcaggtgatccacccgccttggcctcccaaagcgctgggattacagatgtgagccaccgcacctggcacttgatccttttaatatttatctccacatctccaaataacatgcttatattgggccaggtgtggtggctcacacctgtgatctcagcactttgggaggccaaggcaagcagatcacttgaggtcaggagttcaggaccagcctggccaacatggcgaaaccctgtttctactaacagtacaaaaaattagcttggcatggcgacaggcacctgtagtcccagctactcaagaggctgaagcataagaattgcttcaacctgggaggtggaggttgccgtgagctgagatctcaccactgtactccaaccttggcgacagaacaagactctgtcctcccccaccccctgcccccacaaaaaatgcttttattgcaatttctttatttttcattttggaccttaattattgactcccactcaggaaggtgaggttttagtccatttcctaattcttctccagtctacatccccgccccttcagtttcccagtatagttacatgatcattttagttagcttagtactcaagatttacattgtatgatatgtgtactaattagagctggggcatgtgataaactatgattacaattcctttcctgtacaactttttattgtataagaagttgcctttttgtttgtttcaaattccttttttttttttttttggagacagaatctcactttgtctcccagggttggagtggtgtggtgtgatcatagctcactatagcctcaacctcctgggctcaagcgatcctcccaccccagcttcctgtgtagctgggaccataggcatgcatgcaccaccatgcccagctaattttttgattttttttttttttttttttgagacaagctgttgcccaggctggagtgcagtggtgagatcacagctcactacagtcttgacgtcccaggctcaagtgaccctcccagctcagcctcttgagtaggtgggaccacaggcacacaccaccatgcttagatgatttttttttccatagatgaggtcttgctatgttgcccagcctagtctcaagctcctgggctcaagcaatcctcctgccttggcctcccaaagtgctgggattacaggcgtgaaccactgcacctggccaactgttttgatttcttgtagagacagggtcttgccatgttgccctggctggcgtcaaactcctgggctcaagtgatccttggcctccaggtgtgagccactgctcccagcctcaaatactttttaataactgaaccccaaactctcctccaattgtctaaacacccctcaattgtttcattcacacaaaatatggtatcagtttccctttcctgaagaagtctctcccaaagcagacccactccaacctggccagcaccccatatgcctgtagcacagctgtcctcttgggatccggcttttcaatcacctcagggttctcttacttcacttgtatgttgcagctcctgtctcctgtctcacgtgatttctctttcttggtttactcccttgttttgaagcagattccacaatagcttctggaatataagggaggttatggaaggtacatttttgaggccttgaataactttaaatgtctatattctaccccagttcttgattgagggtttggctgaattctagtttggaaaccatttttctttagacttgaaagcactttccatttgttttctagttttcgatgttgccaaggagaagtttgaaattgatctttgttcttttgtatgcaaacattttctttctctttggaaacgactggatgttctcattgtttccagggaactgaaatttcatgatgtgtgttcatgtagatctgtttcctttcattgtggcttcttcccaacacagcaactcaagtgcttcaattctaggaagttgccttgaattgggatggccctctgtatgttttctgttctgtcttttggaacttctattatttgtagattagaactgctcctctaaatttcttatttttctttcctctttccctctttctctacacacacatactttattggagattttctcaactttatcttccatctacgaagtttttcatttctgctatcttgtccctcaccccaagcccccgaaaccttcttttggttctcttaacctccctgttctatagcaaacttttcttgtttcatggatacaatatcttcttctatctctttgaagatattgtagtaataatgagtattttaaggtttctctttttcacgtagtctctattgcctcctggttgattttcttccctctttgtatgctttaacctctggctttcatgttagaagcgtacctcattttaaagactggggtagtacaggctgattgggctagtagaggctgattggaggtgcagagtccatggaagagtcctactgactgtgagtttcatcgtaaaatgatctcaatgggctgtttgagggagaacatccaagaccaattcacttagagttttcctctcaggttggataagaatctcagggaagattcttccattctttcgctgaagggtaaaaacttgggaacctatagagtatcaggaacaaagtaggggaagagactgggatcttagcattcattatgtatattgacttaatcattttgttctcagttgatatccttgtttagagactatttgttttactctttgcaaagagtcaaacctccagtctttttggggaattctggaggcagttagaaagaagagcacctatagacttcggcaggcttcttcataaaatagttttaacaagttctccttattttggccgttccacttttactctcttttctagaagaaccttgtgccactaattcctgagacttttcagcattgtacagtgtgaaacagattagtgttcagcttttcccagagcagctggggaatcaggttttctaaactagataccacttgcatgtatactttccagttcttgaaatctctctctcccattctcctattcttgtagggttttccttttaaaaaaatccccttattgaggtgtgaactgtcagtcccctgccccctgctccatctacttaacctgagggcttagaggaggacatagcactaacttacctaacacattctcaccaaccaaggctctcgtcacctgtgatcaagggaacctgccccatagtaagcaccttatgggacactctgctctattccccagggaaggaagaccaaagtgacatctgagctggcccttaatgaggattctagaggcaaacgatgtagggcagagcatctcggtctgcatcaacaatacatatgtgcaaaggtacaggctactaaaaggccacagcatgccctatatctgattattccaaccagtgggttagcaggatctgggatgaagttggagaccctgtgctaaatcacctgcccccagtcctagtctgccacctgtctcctcagttacgtggatatcctttctgtttcccaggcagttggcccaacgagccctgaaccaagtccagcacaaggccttggtcagccatgatgaattaaggttcaacagcctaatttgatacctgttctcatcacatcctccccaccaagctgcaggcagaatgcatggcacatggtttccttggaacagttttctgatagttctaccgtctgagtcctgtcatgaaggctctctaaggaacaagactagatacatcatatgatcacctgtgtgtgtgtgtgtgttacttaggacaggagccaacatggccataacttaaaccaaatagaaggtgtatttaatgtgggttctgattcactacatccgtgaatgtgccctcatttagaaatatagttgttgcaggtacatagtacagatataatcagtgaagctcatactgaagtagggtggggccctaatccaataagactggtgctcttagaagaagaggaaaagtgggctgggcgtggtggctcacacctgtaatcccaaaactgtaggaggtcgaggcaggtggatcacaaggtcaggagttcgagacccgcctggccaatatggtgaaaccctgtctctactaaaaatgcaaaaaattagctgggcgtggtggcgcatgattgtaatcccagctacttgggaggcagaggttgcagtgagccaagatggcaccactgcactccagcctgggcaacagagcgagactctatctcaaaaaaaaaaaaaaattaaaaaataaaaagaagaggaaaagagacagatacactcaaggggagcaccacatgatgacggcagcagagactggagaggccaagcaatgctgaggattgcaggtgtgttcgtcactgaggattgcaggtgtgttcgtcaggattccccagagaaagagaactaatattatatatgtatacatacttacacacactacatggaattgggttactcagttacagaggtaagcaagttctaagatcttcagggtgagttggaaagctggaggcccaggagagccaatggtttagttctagtctgagtctgtattagtccgttctcgccctgctataaagaagttcctgagactgtgtaacttccaaagaaaagagatttaattggctcatggttctgcgggttatacaagcttcacttctggggaggcctcaggaaacttaacaatcatggtggaaggcaaaggggaagcaagtactatcttcacatggtggagcaggagagagcaagcgaagggagaaacaaccagatcttgtgagaactctaccacaagaccagccaggtccatggtgctaaaccattagaaccaccctatgatccaatcacctcccagcaggccccacctccaacgctgggaattataattcaacacgagatctccgtggtgacacagagccaaaccatatcagagtccaagtccgaaggcctgagaactggccttagtagtgtagttccagtctgaaggtcagcagtcttgagaccaaggaagagtctatgtttcagttcaagtctaaaggcaggaaaggctgggcggcggctcatgcctgtaattccagcactttgggaggccaaggcgggtggatcacctgaggtcgggagttcaagactagtctgaccaacatggagaaaccctgtctctactaaaaatgcaaaattagcagggcatggtggcacatgcctgtaatcccagctactcaggagggtgaggcaggagaattgcttgaacctgggaggtagaggtttcggtgagccgagatcgtgtcattgcacttcagcctgggcaacaagagtgaagctctgtctcaaaaaaaaaaaaaaaaaaaaaaaggaaaaaagctgatgtcccagtccaaagccattcaggcagggagagtcagcctctttgttctattgaactgattggatgaggcccactcacattaggaagggaaatctgctttactcagtctactgattgaaatgttcatctcatcctaaagcactccatagaaaacacccagaaaaatgtttgaccaaatatctgggcagccagaaaggctgacataaaaccaaccatcatagctgacagcaccaggaagctaagagaaagctgtggaacaaatactaccctggagccttcaagaagagcatggccatgccgacaccttaattttagccttctgcctccagaagtgtaagaaaataaatttctcttgtttcaagtcatcctactttgtggtactatgttacagcagctaggaaaataatacagtaggcttctaaagcattttttttgagacagagtcttgctctgttgcccaggctggagtgcagtggcacaatctcagctcactgcaacctccaccttccaggttcaagtgattcttgtgcctcagcctcctgagtagctgcgactaaaggtgtgcaccaccatgcccagctaattttttgtatttttagtaaagacaggctttctccatgttggccaggctggtctcgaactcctgacctcaagtgatctgccccacggcctcctaaagtgctgggattacaggcgtgaaccgctgcacccagcctaatgtatttttttctagtcatttccatgggtaaatctttacagccctagattttgtctagtgctacagtgtgcaatagagtagccactagctacatgactatttaaatttaaactaaaattaaggctgggtgcaatggctcacacctgtaatcccagcattttaggaggccgaggtgggcagatcacttgaggtgaggaattcacaaccagcctggccaacatggtgcaaccctgtctctaatgaaaatacaaaaattaccggggtgtggtggtgcatgcctgtaatcccagctactcgggaggctgaggcaggagaatcgcttgaacctgggaggcagaggttacagtgagccgagattgtgccacttcactccagcctgggtgacaagagcgaaactccatcaaaaaaaaaaaaaaaagaaagaaagaaagaaaaattaaaattaagaacattttaaaaattcagttcttcagttacactattcacatttcaagtgctctgcggccacatgtggttactggccactgtgttagacacaacagatactagatcatctccatcaatttgcacatttccaatgtacaaagttctgttggacagcattggtctagtgtattagtcggttttctcctgcaataatactgcatagcaactccagaatttcagtggtttataagaataaacatttttcttgttcagaggtccatggggcagctcaactttaggttgcaggttggctggacttggcttcggactgcagtttaggttcagatctgctccatgtatctcttatcctctttggactcaggtatgttcctctcatgactaaaagcaggagtgcaagaaggcaatctaaaccaatcatattcagttaacagtccattggctaaagcaagtcacatgaccaagcctaatatcagtgtcctcaaggagaggctctacaaagttacaaggcaaatggtatggatgtatcatcctactataaaggagtgaagaaaaaaaaagtaaaggaatgaagaactgggaataataatccaatctacctcatgtgccaaacgcttataaagaccagcctgggcaacatggcaaaactctgtctctatgtggtggtgtgcacttgtagtcccaactactagtgaggttgaggctggtcttgaacttctgggctaaagcagtcctcccacctcagcctcccaaagtgctgggattacaggcatgagccaccacactggccatccccgttggagttgcctctcatatatatataaaataataatatatataatatatatatttaccttggtgcttttctttttttcttttttgtgagacaaagtttcactcttgttgctcaggctggagtgcactggcgtgatctcggctcactgcaacctccgcctccagggttcaagcgattctcttgcctcagcctcccaagtagctgggattacagacacctgccaccatgcccagctaatttttgtatttttactagagacggggtttcaccatgttggccaggctggtctcgaactcccgacctcaggcgatccaccagcctcggcctcccaaagtgctgggattacaggtgtgagccactgcgcccagccagtgctttttcatattaatatacatagacacaattcttaaattaacattcactaacttacatttactggtttctgtgttctgctggtccccctcttaattaacttaacgatggttacttcagatatctgaacaatggacgtgtgttgaaagacaacacaacctgatttttgccactgggctggctcccaatctggtttaggtgtgttaacaggctgggcccgtcgtctcaagcctgtaatcccagcactttgggaggccgaggcaggcggatcacttgagccaaggagttcgagaccagcctggccaacgtggcgaaatcccgtctgtattaaaaataaaaaaaattagctgggtgttgtggagcatgcctgtaatcccagctactcgggaggctgaggcaggtgaattgcttgaaccggggatgtggaggttgcagtgagccaagatcacaccactgcactccagcctgggtgacagagccagactccgtcttaaaaaaaacaaacaacaacaacaacaaacactgttaatagaggttcttgagataagttaggagtttcatttctcgcttacaatatcttttgtaactaatttgattttatctctcaaactgaagtgttatagacctggtagagtagattcaaggcagctgctctattctttttcttctttcaaaatggttatggccagcatgggcaacatagtgaaatcccttctctactaaaaatataaaaattagctgggcgtggtggtgcacgcctgtaatctcagctacttaggaggctgaggcgggagaatcacttgagtccaggaagtcgaggctgcagtgagccgagatcgccccactgcacaaaaaaaggttgtagtaaaacaactgctctaattcttacccccttagctagtgaaaagatggaaatgcgacaggatagagcgcgacgagtgcttttagggctaaaactgagtgggtcacacacatggcctcctctcccacccgctcctggccagaatttagtcacatgagcgcatctagatcgcagccagacggatggccacgtgggagtgggaggtgatgccactaaaagagagggaatgcttggggaacaatcagcagtcttttctcagggtttgagaaaacactgtgtcttagtgagaagacacagtctgtgcgagttagtaaagtgaacagaactgagtagtcagctccctagtcaagaaattgaacagtcggcagagtttgagatttcttaacgtaaaggaagcgtcaaaagataaaggacccttctagccaggacgcaagactgagggcgagacagccacgcggaggcggggccgccggcggtcgaaggtgcgcgcccggccgacggtgcgcgcccggccgacggtgcgcgcccggcaatggggcgtggccaggcagagaggcggggctccaccgagcgcggcgctgaagctggcagccagaaaggggcggggcctggcggcgataggctttggggcggggcttccaaaccgggcgtcccggctagagtgaaggggcgtgggcactcataggctattgggggagaggttaagaaacgtagaatttcgcagccagaatgggtacgtctcagcgatcctgaaagcagccttgacagccagaggcgagtcaagtggaaaggctggccgggcttcgagaagggagggggcatcgaggtacttaaaggcctgaatcgcgcggcgtgacgtcgggggcgcggtttcgcggcgtctgggcggacactgcgccgaggggcggggctggacgcgcgctccaagatggcggcgaacgtgttcccgttccgcgacgcccgtgccgcaccggacccagtgctggaggccggcccggtggcacacgggccactgccggtaccgctggtgctggacaacgggtcgttccaagtccgcgctggctgggcgtgtcccgggcaggacccaggtcccgagccgcgcctgcagttccgcgcggtgtgcgcccgcggtcgtggcggggcacggggcgcgtcgggcccgcaggtggggaacgctctgggcagcctggagccactgcgctggatgctgcgctcgcccttcgaccgcaacgtgccggtcaacctggagcttcaggagttgctgctggactacagcttccagcacctgggtgtctcctcacaggtgaagggcggagtaggctgggctgggctgggtttgaggggaggggtgcggtctcgtctccgctcactctgctctcggagaggtaacagtcacttcagtagctccgattgtcttttagtcgaccagatgctaggcgctgtgggtgtagcagcgaataaaatgctgctccttgtatcttggagcatacctttgggcatatatgcttgtttgttaagaagcccatttattaacaaatacgtattgagcacttactctgtgtcaggcactttttaggcatttggagtacatgtgtgaacacaaaacttcctgtgcttatggagctgttaatactatggaaagatattctagtatgaaaaggcagacagtaaacatagaaatagtagattctacgccgtgataggagaggagggagttacattttttcagtaagatggtcagggtaggactcgtgaaggtgatgtttgagcaaggacttgaaggaggtgattcaggtagcaagccatgtgaatatctgaaggaaaaacggtccaggcagagggagcagccagtaaaaaggccccgaggcaggagtgtgccctaatcctaactgcaaggctgcctgtgtgagggggagagtagtacctgaaagaggatgtcagagaggtagtggagaggcagatcacacaccttataggcttttactgagtgaaatggggagccatggcagggtgttgagctgaagaaggacctgacttgtgttttaaaaggatcactattactgctgtatggagaatgaattgtcttggatcatagggtggaaacagggacgagttaggaggctgttggaataacccaggtaagggatgatggtggcttagatgaggcagatagcagggaatgtcattagaagcagttggattctggaaatactttgaagatagagccaacacgatttgctgacagtttggatgggaccttgacttaataacttaaattgactctactttcgtattttcaagtaaagatgagatgggagttttataatcgcctctgatcaggtttttgattaagaagccaaaagcaaattcagtcctgcaataaggattttgggttcttttatgcttcaaaaagagtattctgttaccactcatttatttgcccttttctttcaaagtagggctgtgttgatcatcccatagttttgacagaagctgtgtgcaacccactgtattcacggcaaatgatgtctgagcttctttttgagtgctacgggattcccaaggttgcctatggaatagacagcctcttcagcttctaccacaataagccaaagaactcgatgtgcagtgggctaatcatttcatctggataccagtgtacgcatgttttacccatcttagaagggaggtgagttgcacttgtggcatttgagtgcgattttgagaagcattcaggaaacatttatttactgcgtgctttaaaggcagagtagaaagagcaagtactagcctgtgaactgagccgttgggcttagctttgaactacctcactgtgtgactgggtaagtccctttgcccatagttgtgtcctttgtgaccttctggagggagttggggtggatgatctcttagttccacatccataattctacaatattataattctgacataatggggagatagctaacatagtatctgcaggtagtaggcattcagtagaaatgttttgaataaatttaatcgagaccatctttgtgttctggagttttttttgttttttttttgtttttgtttttgtttgtttgtttgtttgttttttgacagagtcttgctctgttgcccaggctggagtgcagtgggatcttggctcagggcaacgtccgcctcccgggttcaattgattctcctgcctcagcctcccgagtagctgggaccacaggcacctgccaccattcctggctaattttttttatatttttagtgagacagggtttcaccatgttggtcaggctagtctcaaactcctgacctcaagtgatccaccctccttggcctcccaacatgctgggattacaggggtgagccaccgcgcccagccaatttcaagttatttaatcactattgtttagacctttcaggtacagtgcctggcacgtaatggacccttactaaatattttcaagttgaataaaaggcaagggtagtttatgtcatatttaaaaatctgttgccactttatcgttgagctttaactgtctgataagagcctaggccaccactgtgttctcctgaggtttctcacattggcacaaagagacccacgctttacagctgaatgcctgggtttgcagctctgctacttaacttcctcacttcatttcctgatacgtaaaattgggaaaaactgatttcccagggttaccctgagaatgaaatgagataaggtaggtaatggcactttgtaaactgtaaagcagactgaacatataaggcaaataccattgaatttctcatgaagtttctatgaaaatttttgaagaaaaaagtaattcttaggtgttaccaaatgctcctgatgtatgaagttctctatgtaaacagaatatgcaaaaataaaaagtaacatattttatattgagagaaaattacctgaaggctgggaaattatcagagtgaatcatatcgtgttctatgctggcatctgctggtgaggtatgatacagcagtgacattttagttccctacagtaagttcctagtgctctgccacttactttctcacattaggaaaataaaattattctggttcttttacagtaagtcaggatgcgtgtggttacttaacgtgtttgcttcagtagatgtggagtgttaagggagggcttcttaaactctggccttcagtcacctagggagctcattaaaatgcagatccccaggccccaccccagagcagctgtgtcctgggaattggcatgtttaaaatttcccccagctaattctgggatacctggtcccaggactacagtttgagaaatatatgacgagactcattaagatctgactggagtgcatacttgttaggtggccgtgtgactgtatgggtgagctaggaatgcctgcctagataagaggttataccaggggaacttcaacgtcccttctgactatcaggttttgtatttctcctgctggtctgtttcttctttatctgccttaaattatcttgtttctcccaagatgctccatatttctgtcctccagaaatttcagtgctgttttctactgcttggttatagattagatgctaaaaactgcaagcgcatcaatcttggaggaagccaagcagctggttacctccagcgtctcctccagctgaagtaccctgggcacctggcagccatcaccctcagccgcatggaggagattctgcatgagcacagctacatcgctgaggattatgtggaaggtatccaagaggatgtttgcctgcagcttttgggtgttgtctaccttgtattccttaaattattgccagcatgattctttgcttgctcactttttaagcacctccttcccctttttgtattccctttcttaaactattcagtaaactgataacttatgttgtataggttcccttcacaaatggtagcttttataacttgcctttaatacagaacttggaattgcacaactttcagcttttccagatattaaatatttttaagagtgagcagaacatatcagactaaaaatatcttaagctagaaaacaattgaaattgttttattatacccttataataacatctatgctgcagaaacacctctttttcttttcaaacttgtcttggacttttggttgtattttacttcaaattaaagtatgagttttagttgctattgtcacatgaatgtgatgaaaatatcttcctcgtgaatttaaatagttcatataaaaccaaaggactacggacaatgccactgtgaatacaactctattccaagaatggatttgcttgttgtcattgagggtactgatctcagctgaccaataatgagctcctgaaggacaaaaactgcatcttttttttttaattgtgaaaaccatataacataaatttgccattttaaccatttttaagtatacgtttcatgtgtgaagagctgtgttttaattaactttagaaagcatttattaaacatctgttattcctgggatacaaagaagttgcgggagacagatagggaaataaataattgatgaggacactcagtccggagagttagaggcttgccagaagacacggctgaggcacacagctctccgtgctcccacttctctgttctccagttgctctggtattgactctttttttttagttaactttttcttttacaattctatgatatgattataaagagagagcatgagggaattttttgggatgatgaactcttccgtatcctgattgtggtgttgattacatatgctttctctttataatcatatcctgtttttatccacaataaacaggaacaaactactgatacactcaacaacttgaatgaatctcaaaggcatgatgttgagtaaaaaaaaaaaaaagtttcaaaaggtacatactatttgattccatttatgtgacattttgaaaagataaaaccatagtgatagagaagaagtgagggaaagattgcctgggcttgggatagagacaagcttttgggtgaacttgttttcatttctccagagtaaatagattgctgggtcatgtgcttgcatggtatgtctttccgtccttctacttttaatctacctatatcattatattcaaagtgaatttcttggtagttggatgatttttaaaaaaaatctattcagtcaacctctatttaattgttagactaaaccatttataattagttttaattattcatatgcttggatttaggttcaccattttattatttgtttttgttccttctgtttattgttcctctgtttctctctcctgcctccttttaggttattcgagctttttttttttttttttaaagtattttatctgttgtgttttttactctacctttttattgtagtttttagtggttgctttagagattacagtaaacacaacttttcacagtctacttagattctgtatttaccacttcaaggggaatgtggaaatgttagcaatgtacagactcctttatttcgcccggtttatcttaaagttgtcttatttatttcatctgtatacattggaaacccatcagacagtgttgtgatttttactttcagttgtcaaataggttttaaagaactcgtaaggagattagtctgttatgtttaaccagatttttatcatttctgttgctcttccttcattcctgatgctccaagcttccttctggtgttgtttctcgctgaagaacttacttagcagttcttttagaacaggcctgctggcattatgtccaggtttggtagctgcttttagttgattgagtggattcagggattggatggagtgtattttctccatctgacctatgtctgaaatgctggtactgactttaaaaaaaacaatggagtcggccgggcatgggggctcatagctgtaataccagcactttgggaggccgaggcgagtggatcacgaggtcaggagatcaagaccatcctgggtaacatggggaaaccccatctctactaaaaattcaaaaaaattagccgggcatggtggcaggcgtctgtagtcccagctactcaggaggctgaggcaggagaatggcgtgaacccgggaggcagaacttgcagtgagccgagatcgcaccactgcactccagctaggtgacagggcgagcctcccgagtacctgggatcacaggtgcccgccaccacgcatggctaatttttttgtatttttagtagagacagggtttcactgtgttagccaggatggtcttgatctcctgacctcgtgatccgcccacctcggctccccaaagtgctgggattacaggcgtgagcccctgcgcccagctggtattgactttaattgttgtgttaatagtgtttccatttcataactttcaaaattgtttctttgaagaattacacaaatggcggtgtcctgattattatgagaataatgtccacaagatgcagctcccattttccagcaagctcctgggcagcactctgacctctgaggagaaacaagaaaggcggcagcagcaattgcggcggctgcaggagctcaatgcccggcggcgggaggagaagctgcagctggatcaggagcgtctggaccgactgctatatgtgcaggtaatagcagacacagggacgggcgcccttccgtgttaacaagatagtctcagaagattttcttgcatatttttccattggccttaagatgctttgactgtttgtcacctttggggtcacgaaggagtccagggggatcatcagcatagaatacagtgtagaagcagctgtttctgaaagagctgtggactccagcattatttattttcaccttataaactcctttatgtttttaaactttgtaagtgtagcatacatgatgcaaagtgcacaaatctttatgtttcatcttgatggattttcaaagtgaaactcacccgtgtatctgctgtcaggttaagaaacagcattgtcagcgttccagaaggctcctttcatgtctcctcttagtaactttcccaccttccttcacatcccccgccccaccaaaaaaaaaaagggtaacaaccttttagacatctgtcaccatcattagttttacctaatcagttgttgctggaactgtgatgcaatgctagcctagagacagagaggtgggcagctgtgtgaaactggaggcagctggaggcgtggctctgggcagggtaggccaggggagctctggaagccctctccagctgtcgttttctccgtttggctttgaagctactttccttcctgtttgtgactgctctgttttcaggaacttctagaggatggccagatggatcagtttcacaaagctctgatagagctgaatatggactccccagaagagctgcagtcctacatccagaagctcagtatagcagtggagcaggctaagcagaaaatcctccaagcggaagtcaacctcgaggtggatgtggtagacagcaagccagaggtaacttagggccttggaaggagcagcccttcttgaggggaggagtgtcctgagaggcctgacatcaaaggggttgtgcccagagtcaggagggaaagagagcagaggggatgtgggtggtggtggagatggcactgaccttgtaccaactgaaattctgtcagaagggatttcaccctgtagatccccggacccctgagcgcagaaagtgcatttaacgtaggaagaacattcacacaccaaacctgtggtgctgtcttgaacctaaaccagctccactgatagtcattggcagtcatatacttcctttaattttcttttagtgttttattaaatatattgtggttgattgttcacttacctcctttccatcttgatgttccctaaggacagggatcatgcttcatacatgatttatgaattttttacagcagttggtagttatgctcaataatatatgtataggttgccttaagatcagccttttattagttgctaaagaccctttgcataagctctttgattttctcttcttcttcttcttctgtttcctcacccgtgcactgttaataagtgtttttgaggccgggcgtgctggctcacgcttgtaatcccagcactttggaagtcccaggcaggcagattatctgaggtcaggagttcaagaccagcgtggcccacatggcgaaaccctgtctgtactaaaaatacaaaattagctgagtgtggtggcacacgcctgtgatcccagctacttgggaggctgaggcaggagaatcacttgaacctgggaggcagaggttgcagtgagccgagaccgctccgttgcactccagcctgggcaacaagagcaaaactccatctcaaaaaaaataaataaataaataagtatttttgtttgtttgagacagggtctcactttgttgcccagttagaatgcagttacatgttcatagctcaatataacctcagactcctgggcttaagtggatcctcccacctcagccttctaagaagctaggactacaggtgaacgccagcatgcctaagtcatttttacaattttttgtagagatggggtctcaccaagttgtccaggctggtctcgaactcctggcctcaagtgaacctcccacctcagcctcccaaagcactgggatgacaggcttgagccaccatgcttggctgttaataagtgtcgaagtagccaaaagagcttaggccccagcatcttagttcctgtatggcaaaggggcagcctgcaggtcactcctcagtccagaagtcgctggttgagtcgcctgcctttagaactgaaacaaagagtaagtgtacatcctgttcctggatctgtcatccctagaattccaaaacaaaggaacttactgccttgagacatgttttaggcaggataaaccagactagcctcttgttttttgttttttgttttttcctttttaaatcagctttcattaagctgttgattacttatcctttcagaaaaaaaatgatactttggaaaaatgcaagtcagtgccatttgatgctgggtgtagcatagtgcttatcagtgatgtcagagttgcctttggctcaacaggaagcttgcttttgcagtgatgggctcccagctggaggctcgctcaaggttctgctctcaccgttgcatcctctacatctcattcccaggctgtcgattatgtgaggacagtacatgagtgtatgctttatagagcagatcctgagataggcttactagatacaccttattggatcaccaagatcttgtgtagaaggggcctttaccatcttcttccaacacagcatcccagatcagcctcagttgaatcagtgtgtgccttttccattttgcttctcttggtttttcaggtctttgagatttgagttgttgtttactgaaatccggaaccatgttgtctttgttatgtattcatccatatttagtttttatcatgcttgacatgttagcaggacatagttttctttataccagagcagtgccactcagccacaagcagatgagggatttcagatttcaaaaagggaaaaaaaaccaaacagctgtgaagatgtgattcttcagcagtggggaaactagtttttccttttctttgttcatttgtctgcatttgttacatgatgtgattcatcacccattcccccattctttcagcagatactcagtaggtacctacttcattttatgctctggtacacacatttaaatctccttgggtttaggggattttgaaatgccggactgcaaaagatttttctatatgcaacaaatttgatgatcagttgggccgggcacggtggctcacgcctgtaatcccagcactttgggaggccgaggtgggtggatcacctgaggtcaggaattcgagaccagcctgaccaacatggtgaaaccctgtctctactgaaaatagaaaaattagccgggcgtcggggcaggcgcctgtaatcccagctactcgggaggctgaggcaggagaatcgcttgaacccaggaggcggaggttgcagtgagctgagattgtgacattgcactccagcctgggcaacagagcaagaccccgtctcaaaaaaaaaaaaaagtgatgatcagtcgtcaaagctttaatggttagtcagcattcagcattttagggtaattcttaatgatcagagtcaattacagtcacatttgtgggataaacttgaccatgacaatggctagccagttctaccattcaaaaagtatttgtagagtttccaataatataattcatttagaatgaattgaatcaatatatgtgaaccaaaattcatattgaaattgcacttaagcagtaatggctgaactgaattaatacagctggaatttaactaatagaggtctcgaaaatctattttttcttatagaccaatctattctgacccttgctattctgcagttgtttctgtgaggatgttgtgaaggagcaggctttgttagcatttttaccaagtatttaaaccagaagatgcttgcttttcatagctacaagcacagcataagagggtaggaggggggagaacacaggttttgagcatcatcatttgttggaaaacgcaatgggccaaatatagaaagttctccggctttactagccaagatcagggttggcctctgcttcttcttatgccgctcaaggctgttttagggaaccatgctgcatcttctgtggtatgccttggcaaactgtcattccctgcagttccaaaagaacagtcatattagtgtttctgaacgccacataagacatgtggagaccctggcaaactctagcgagagagaagccagccgtggcagagaaaactattctctgttggatgcctgttctctgtgttgaaatgatcagctttgttcctctctgcgacttgtatgaattgggataaataaatgtcctttttataatttttgtgaagctaagaagttatcttaagatggtatgctttggagtgaagctaggtgaaggtgaatgttgatttttttttggcagctgaagaaacctcttgaaacccaaagctttacaatcatctctatttcaggggaatttgagggtgtatcccaggggcccaccactcagtgacaggtgcagtataccagggatgcagaggtgattaagatacaatgcctgccttcctgggtacctcaaaaacaaaaaatgagggctatagcaccatgcttagctgactgtaatgaagcgtagcaggtatggtggtaaatgtgtgtgggaatacacatttggttttttgagaaggactggatgtttcagctgggccttgaaagattatttgggccgggcacagtggctcacatctgtaatcccaacactgagaggctgaggagggaagatcacttgtgcccagcgctttgagaccaatccctgagtcacatagaccccatctctaaaaaaaatttttttaattagctgggcatgcatctgtagtctctgcttgagaggctgaggtgggaggatcacttgagcttgggagttcgaggctgcagtgagccatggttgtgccactgcattccaacctgggcaacagaacaagaccctgtctaaaaaaaaaaaaagaaaaggaagattatttgatttcagtaggtagcaaaaggaggagggaaggacattttaggtggaaagaaccacacatgcaggcatatagagtgtgaacaagaaaagctgtggtgggtgatgaagtggagatgactattaagttctttacccatcagtcttatgagcctgcatattatccttcagacattcggagccttccagggatgttgagcaagggaatgagacgatgagattttgttttgggaaactaactggtggcagttaggatgatgggttgaagggaggggtgagactgcaggtgggaaaacaaaacagatgtaggatcagatgtaggatcccaagatctcgctgccatttgcaagccaaggtgacaagagtagcagtgttgataatagagcatgtggcatgtgccgactccttgctgagcacctacgtaggtgtcctcctggttcgtgttcacaactcaatgggtaggtactatcattatcccccttttacagacaaggaaagatttggagtgaggtcacatagctagaagtagtgctgatcaaattcacacacaggcagttcaattccagattccacccttgtaacccttaggctgtattgaaaggcagtgggtagatggtagtgccttttgaccaagtttgggaagataattggcttagttttgagcaccttttttttttcttttttttaagagattggatcttactctgttgcacaggctggagtatatgttgtgatgatggctcactgtaatttatccttcagacattcggagccttccagggatgttgagcaagggaatgagacgatgagattttgttttgggaactcctgggctcaattgatcctcccacctcagcctccctagtagctaggactacaggagtgcaccaccatgcccggctaactttttgctttttaattttttgtagagatgggtctcactgtgttgcccaggctgttctcgaactcctggcctcaagcaagcctcccaccttgcctttcaaagtgcagggattacaggcatgagtcaccgtgcctggccctgagctccttatctttaaaattgttgtaggacatcaggtggagcttttcagcactctgtgggacatcaggtggagctatgggaggacagaatcaaatggggaggaagaaaagaaaaattcctggagaatgccaccacttgaaagttaggtgacagaagaaaagccaggacgaagattgagcaggagcagtaagagataaaggaagccaaaagggttgatgggagagttaaaagcttgaatggtcagcttaacctaggatgagaattattttttgaaacaaggaaagcttgaaaggataagaaaataggatgtgagggtgatctggctgcgatatctgtcaccccattgattgccagggttgattcggctgatctggctggctaagctggtgtctttctgtcctcaccacttcgtgtgtgtctctcccaaagctgcatgcttggtcgaagaggacgaccatccccaatagaggaggactgatcttccgtcaagagtatacgagtagctgcgctcccctgctagaacctccaaacaagcgctcaaggacatgaaaatagataaggaagtagaatgaagaataaagagggaagttcattttttgaggcaactaagatgatcttttaagatttccagggttgagattagaaaggagactgtggagaagggtgttgggaaagggcaggcagaaggaagctgagaagtaaccacaggattgcctaaatagcacctgggactttctgcactcctgcccccctggagcatatttaacttttctattgctacaaaaaccattccaaacttagcagcataaaacagcaaccattttattgtgctcatgggtttggtgggtgaggaattgagagaggctacagggatctctgcttcaagttgcctggagccactgctgggaagaattaaatagttggggactggaatcagctggagggttttttacttacctgtctggtatctgggctgggaggactcaaggtctgggttcatgggggactcttgacccaggcacccacatatggcctcttggtgtgccttgggctcctcccagtgtggccactggtttccaagagggagcttcccaagagagcagctagagagtgaatgtttcaaaagatgaaagcataagctgcatgacctttcaggaccttaccttagaagtcacatgacatcatttgcaccatactttgttggttgtagtcctcacagtcccccactgagactcaaggggaggaaacaaagaccctccacctctgtttggggagtgtcaaggtcacattacagaaaagtgtgtgggatagaagtcactgttgtgaccttcttttaaaaatataatctgctccggagcccaagtggaaagagtactgggaggcatcctttagactgcaggcttactggttgggtgtaacagaagcagatagagttggtggagggatgacggcaaaagtgattggattccaggctgggtagagaagggcatgtgaatccacaggaaaggtcatcacttggattgagggaggctggagtggaggttaggatgaagatgaagaatagggtaaaaatgtgggatgtagagaggaaggactccagtggagcccagtgcttgctttcacctgttacttggggaatcacaggttacaggttttgtctgtagttattttaaatacacagatgacatctttgtcttcaacccagtaatacaacagaattatttaagggaccaaattgagtgtgtgtttaaaagggaagagggaagcgttgttcgtttctcacccgacgctgccctaagttcacgtcccacttttacatagatggagaagcagctcagagtgtactgtttccagctctagtactgtgacctttaatatacctttggttgccattccgagctggatcagtgtgactccagagcctgaccaccttctgttatgtcacactgcctcctggttcctggttcccccagatgacaaaccaccaaatgaaaaagaactttgatgattaatttccattcctcccctggaacccctttggggtcattcctgaagagctgggtttggtgccaagccagaataggcacagacactcccatggtagggctcctttcttgtgagggaagctgagagtcttccagatcacaaactgcagatggcaaggggaatgttcctttactccctctctgctgtccctgctgggacagaggagcctgtcattgcctcagctggtcttgctgctgcatgtaaaatctttcattcatctcttgtattacctactctgacctcaggctagattgttttcatgttcctaaagccccaattgtcttatccttagcctcatgatttatagaactccagcttaaggcagaacaaagactttggaactgagcagttctgcctcttcccacatgtccactgcctactagtgtgatgtgatcttgggcaagttacttcacctctctgagccatagcatcctcacccatcaaatacagtaatgtctgcagtgagggttgtgcagatagcaggtgtccctcccctctttgtctgattcagtattggcagggacagcttttgcttccttccctgagagcaaggttctttagattcgtgtcacccaacccatcttcctcctcctcagattacctctataaaccagccccctcatcctgtgcacaagtctcacatgaagaaacattcactttcctttccagggtttatcctcaagcctggaaaatccccctcaaatactgtagaatcatctatactgaacagaatttagagtacattgtcacccatcttgcatgccatatttgccacatgacttttggtgtgtgaatgtgtgtggggtattgaggggtattgccttattttaatgctagtttacatttgcagtatatatgagtaggttctagagaagtatatttaagtcctctgaattatgttggtgatttacatacttcataaattccgagagtaaggagagactcagaatgcatactcaatggcgcagtctcctctcaagcatacttggctttggttacactctgcttgaaccctcccaagacactacctcataagacagtccattctgcagcagctgtcattgttacagcattcttccttgggatgcaactaaatatttctacccagaacttctctccattgagtctaatgacagatggctaaagatgtctttcagaaccaccaccatccccaacttattttgtacagtttaaaattaaaagcaccctaacttctcttttggaaatggtgccagcatgtctagaccccttccaggttcattgtggtcatagagggaacttgttctgcaggactccacagatagcaagcactctgctaccttggagcctctagtcgcattcccagcccagtgggacctgctattaagggactgattgttgagctcattagcgttggcacatacatttatttatatttctgaggcagagtcttgctctttcacccaggctggattacagtggcatgatcatggctcactgtagcctcaacctcccaggctcaagtgatcctcgacctcagcttcccaagtagctggggctgtaggtgctcaccaccacgcccagctaatgtttgtattttttgtagagacaaggtttcactctgttgcccacgctggtctcaaactcctgggctcaaggagcccacttgcctctgcctcccaaagtgcagagggattacaggcgtgagccactgctccctggccagcagatgtatttattaattattaaaagattgctttaactttgctggtagtctagctgccttgtaggatagcagctgtcacacccttctcttagagttgcgtgtgtggtggtgtgactcatgcaagcagcaagtcttccacggggcccagccatgagctggcaccatcagaaggctttagagaaggcgggggttggtgaggcttgtataaagtaggaaaggtaggagatcaaagcaaagcccgttcctggctttttagtcttcgtgttcatgtgtgcttttttaaaaatagcttagaaaaattttcatagtttttatgtaaggttttagaacattgggcaagatcccagttcttttttgtggcactaaaatgatagaactgaggcctgctgaaggtacaggttctgtttcattttgctccttctcttagacccctgacctggagcagctggagccgtctttggaagatgtggaaagcatgaatgattttgatcccttgttttcagaggaaacacctggagtggagaagccggtcaccactgttcaggtttgacttctacagcccagaacatgcttattctttgaaggtgttgacctaaatggctgggctagtctgtttctttaggacttaaaactgttatgttttttagaaaattgggtaccaatacttaaaacatctgaaatcagggatttttttcccccggtgattgatcgattggttctagtaccaagatctgtgaatctctgagaaacagtccacccggcagaaacatttggtaaagtaattgggaacttgagatctgaatactggcttgtaatagtttcatttacatttaagccaatgccagtacacataatcctctttggaatctatgtttctgtcattacaatgccaaccagataaactgtcctgagtctgagacccacctgggagagagcttccttgccgtgcagggatagggcactaagcaaggcactgagcaggagacttgtcctctagactcggccttttactgctgctctccacaaagcctctccctgcaactcggggaccatttcatgatggaaacatgtacatgtttataatacacaggttggaagaaggtaggaaattgaattagcaggtcaagagagttgggagaagctatactggcattaacaagggacagaaactattgggattaagaaacgcagtttgaggaaactagcaactggaatgtttgtcatttggcctaaaaatatcttttaaaccttgggtttttaaagcccgtgtttaacttggcagcatatcatcagctatttgttgggacagaaagaattcgagctccagagattattttccagccatctctcataggagaagaacaggctgggattgcagagactcttcagtacattctggacaggtgagacagcgaatctgcttttccttctatcttcctgaaccatttccttggattttgcattgaatggtagatttgatggtcaggcacttgaaaatgcatctcactctcttcttttcattgacttgctgtgctcagatagtattcccttcatctcttatcaccaggcctggcacgtaactggggctctgtagttgttttctgaacctgtaaatgctgggttgactgagtagctttaagagtgtcttttaagtttgaacaacccgataacatgtacactggtttccatgtaaaccttcacattattaaagactagtgattttaaatcaccctaaaaatattgcagagctaataaaatttttttcccctccttgcaggcattttacttatttaagagttacatttccataagaatccaggtgttttacccatttatgcgggcattttcctgcagtgtgaatttgataattcaagttgggcaagtagagaatggaattttgtaggactctggctgctgttggtcataacggcagggaaacttgtacctagcaaggaagaaaaagctgttgctgctactttgtttgagtggctttgagctttgtcttgacagtggttggaaagtgatcaaacatgtcttagataaagctgttattaaaaaagataaaaagaaagcacaggtcgatagatgggccctcaaaagggaggcatggcttttggggataatggaaatgttttgtgtcttaattgtagtgatggttactggaatgtataaattagttagactttatcaaaatgtatgtaaatttatcctcaagtttattttttaaatgtattataaaagtataaaaattctaatcatgttaaggaaataagttgaccattcagattacggttttgtctggctgtttggaaacattgggctggcgttttgtagagacacaaatgaaaaatgaaagttttgattttttttttttttagctttttgtgtagaagtttttctgttttgtactgagagcttacatttctgcatccacatttcgttctgatatttgagttaagggactatattaggagttgtttctttcctaggtacccaaaggacattcaggaaatgctggttcagaacgttttcctcactggcggcaacacgatgtatcctggcatgaaagccagaatggagaaggaactgttggagatgagacccttccggtcttcttttcaggtactgattgttcgagtagtcaattattttgaaaatagcattacctgttttctgattgcaaaagtaataatcatgcagaaatatccactgttaacatttttgtggcttttcttctggtcttaagtccatgcttaatttttaaagcaaaatgggaatcatgttttatatactgttttgtggtttctttaaattggaagatgaagacatgcgtagaattctaagagtgtgaaagagtgtacatcaaaaataagtcattctcctacccagtccgggcccctgtagacattgtggggcatgggatacattggagcgttccagacagaaggactagcatgagcaagggcacaggggccagaagcttgttgagggagtgagaagtggctgagtgttgctggagcacatggctgataaagaggagaggaggtgggtaacgtagagaggtcagcagagcccacactgcagagcctgtgcatcctgctaagaagcttggccttggtctgctctgctttgctgcatgatgtcgtgtacattcaggggggcgtctctgggctttggtgctgactccatcatcaccattactgaattgtgctaagctttggctgtctcagtggtaggaagggggtaatcggtacctgttgctgggattcagtgtactggtgcctgtcaagcgcccgacagtgggcctgcatgtaataaactctcagacatgagctgttgtgttgagggtccctaagaccattccaggcaggatgattctctgggaggattcacaggactcagcttgtaatcctacttacagctgtgacttactacagcaactcagcagagagacaaggtgcccggggtgaaatctgggagcaaccaggtgtaagcatccgaggcctctccctgtggagtcacacaagacataatttccccagcagtgccttgtaaaagcacattaagtgttgccaaccagggaagcttgtaggagacgcagtgtctagggtttttatttgggggctgatcacataggcaccccctgcttggagcatacccaaattccaggctcacagaagggaagcacgtgtttggcataaaccacattatttgtgtgaatgggcttattgagccattcttatcaggtggtggtaggaaccctcccaatatccaagttcccagatgcctaccaaggccccacccttgtaagtatgcctttctaaggtaacagtagggtggtcctgttaactcttttctgcacagctcttatttttaggccatagtgatgaaccatgaaggagtctaagcagggaatgtgatctgatttacatttagtaagatatatttgacactgttgtgcaaaatagagtattaagagaaatattggaagcagaccagttaggaggcagcttcccagcctctaggaggaagtcctcactccactcaccaggatttacagggtctcttgtgttctgaccttaagaactgtccagggttctctcatcattcccccttccacccgctcgtcagccacagctaaccactattagttttccagagttttcctgcctcagggcctttgtacatgctggctccctttgcatagaatactctttctcctcatccagctttctcagtggctggtttcctggaaatcacttcctccaggaagccttccctgtctttccctatgttccttacaagatccacctcttgtaagggaagagacagccactgtcttgtgaaaagtgtcccaagcccttggcacagtattacttggtagctctgcaggaaatacaaaagcagtggcagagggagaggaagagagggagttgatgtgaaagaggctaaggcagtcaaattgtcagagcttgatagtaagttggatctggggagggaagtcggacctaagataattcctaaattctaagtggagcaactagtttgctgattaagagattcactgaacgaggagccgcgggagggaggacaggcttaagggagaggatagtacgttccatttccagggtgggttgagtttccagtggacacacgaaaaggtggccacagctagctggatgagcgctcggtgggtaagggggaaagcaagagggtagtttcacaccctcccacctgccacaaacataaaatgtgctctgggcactctttgggagggtagtgatgttaaggatgaacccctaaagaacactagcatttaagggctgtaggacacccatgagtctaagaaggaggtggaggaagaggagtggggagcaggagagagcagcagtgctgaagccagggggtgacagtaaggggcatgagcatggggctgggtcacgctggcagcggcgacttaggatgaagtagtagagaaaaaaatcgtagaggattttcaagatctatttcttggtaatttccaaagtctcccatgaattactctgtgagcattggttgtggaatgctgctaccagccagatcttttcccagccctgcttttgctgttatggtgtcacctggcctagcctcagctcccccctcccctcctgtttctgccccctttcacattgctaatgtaatgagtgtgtcacactgtcactaagccctaatgttccaattttagattatgtattcagcagtggctcaaacataccaaccacctaaggccctccgtgatcattagaaggaagagaaccccaagatgtgcaaatttacaactttaagttcctgttttttcttaaacagtaaaacatttttaaatattacaaaaatatcagacaatttaaaccaaaatgaaaaccaagaaaactgtagtttcagcctctgcgagcaatgttctttgtatactttccagtcgttttcatctcatgtatggttttaaccaaaaagagattggtgatagcttattttgtaacctgtatttttttcactttcaaattattatgacaatttttttatatcaataggtacatttccagagcatcctttttatggctgtatagtctattaaccatatgtcttgctgcattttttattagtaatgatgacagctatgctttattgaatactctgtaccaggcagcatctaccatgtgccttacactcatgcacttaaatcccctgaagccagggggtggggcctctggttatcctagtgacaaggtcctcattcacaggccccttgcccacgtggcaagcccagcagctggactcctgagcctgcactttcccacctccatttgtgcatgttgattccactgttatggcctctgcccttcagtcccgaaagttctgaaatcaccattctaacctggaactcatgggattggtggagtggggaggtgagagggaggtaggaagtgaggcgggtaactccagaacacaggaggcccgatggaagctgcagtgttaccataatgatcagatcagcctagccgagggccttctcagagctgctgaaccccagcccaactccagtgagaagcaggggaaactaagtgctggcagcctcacagagaacgcccaggtcacccctctctgctgccatttctcctgaggctcttttgctaccctggctagagctgccttgcagcggcccctgtttccctctactcagagtggggagcggggccaggaaggccttttccccaggtcacgggccagcctccacttcacctctccctgacagcttgtggttgacagcatcaggcagcaggaggctgagccactggcccctctctgaccccgagtgtcaggtcttatgttagtaaaatgtctgacagccgtctgttctggagagtctgggcattccagctcacctttgtttacagggtgtggagctagccccgaactgtcttggagtgcactgggcccacctatgtgtatatttctggggataaaatatcgggggctgtagctgagccaggtcaacattcactcctggagccctggtggaggtgtcctggtgaatctttgtgtttcaggttcaacttgcctcgaaccctgtgctggatgcctggtacggtgctcgtgactgggccttgaaccacctagatgataatgaagtttggatcaccaggaaagagtatgaagaaaagggaggagagtacctcaaggagcactgtgcttccaacatctatgtccccatccgcctgccgaagcaggcctcccgctcctcagatgcccaggcatccagcaagggctccgctgctggtggaggtggtgctggtgagcaggcatagcagaggccctccagagagactgccctgcacgccatgccttgggccacgttggcagtgtgacaggactgtgattgtgctagatgtacctgcccaagtctgctggtcacatttggcagcaaaatggatttctcctggggagaacaaagttaagggacactgagacctgcccttcagaattcggttcacttgggggcttctgtggtagagactaactggccttctgatgtctttgttcaactgtggccagctgtggcatcagcttcctggagcagtaaatgaagacagagtggaggacacaaatgtacaaaatgcacaagactgatttcttaccacattttagtctttcttgttttaaaaaaaattctttaaaatttatcttgtccgtgtagatactttattcttctggatgtattcagaaattgcatgaatgcccagtgaggggaggtctttcatgcatataaaaaggtaatgtttattgccgggcacagtggcacgtgcctgttaaggcccagctttgtgggaggctaaggcaggaggatcgctggagcttaggagttcgaggctatcgtgtgctgtgatcgcacctgtgaataaccactgcactccagcctgggcaacataggaagacattgtctctaaaaagatacatttttcataaaaggtaatgtttattcaataaaagcagttgcctcaggaaccggaaatatttccctcctcctattttttccccttacagataaggagaaaagcccagaaagttaccagcatgtgaggtcactctgcaagccagggacttgcttggtgccagagccagtggcccaactttgttcatactttctctgctgtaaacttttccaccatacaaggcctacaaatgttttatttctgtccttctgagtttgttggcttcttaactttttcagactttttggaagaaagataagactggaggaggtttatcctgtagcctgttcagttttgccataacctcccattccctgtaccttcccagctgtgtcttaagtggacagataacccctcaccttcacagagattgctcggtgagaattttaactcaaagacaaccaattattgatcccagaaggcccctgagctaatattgtcactgaatttgtacctttaaatcttatggagcctctagcccacccctctgatgaggccaccttagaacctgtttgctcatacagtctaccaagggtcatcacctggatctccagctctcaagggcttagaaactgcagaccggaagggaaggggcagtggtgatggagagagtggaagaccacagctgaccgtaaacaaaggaaaaaggaaaggttatcgcaaacctaaatagaagatgcacagggggaagatactccattgaaaagaaatgaaataagaaagtaatagataaggaaaagaggcaaaggaaattaaactgtagttgaagaagaaaatttaactatattgagttttgtggtggtgatggtcaaaacaacatgacaaactttaccatcttaaccatttttttttttttcccgagacagagcctcactgtgtcgcccaggctggagtgcagcggtgcaatctcagctcactgcaacctccgcctcccgggttcaagcaattctcctgcctcagcctcccgagtagctgggactacaggtctgtgccaccaagcccagctaattttttgtatttttagtagagatggggtttccactgtgttagccaggatggtcttgatctcctgacctcatgatccacccgcctcagcctcccaaagtgctgggattgcaggcatgagccactgcgccgggcccatcttaaccgtttttaagcgtccagaacaggggtgttaactctgtgcacattgttggtcaaaagatctccagaactttttcatcttgtaaaaccacactcaatacccatcaactcccttccccctgcctctgtccatcccctgctctttgcaaccaccattctactttgtaagagtttttctttagataactcacataagagaagccatacagtatttgttgttttgtaactggcctatttcacttagcataatgtcctcaggcttcctccatgttgtggcatgtgtcagaatttccttcccttttaaggctgaataacattccatcatatggatataccacattttctttctttaccttcgatggacatttaggctgcttccatttcttggctattgcaggcaatgctgcaattaacatgggagtgcagatatctcttcaggatcctcatttcaatccctttggatatatacccagaagtgggactgctggatcatatggtagttctatttttaattttttgtggaacactcgtactgttttccatagcagctgcaccattttcattcccaccatcagtgcatgagagttccagttcctccacatcttcaccaactcattatgctgtttttttttttttgatagtttcctcatttactatctttcatctttttgataataaccattctaactggggtaaggtgatatttcattgtggttttgatttgcatttccgtgatgattagtgatgtggagcatctctctgtttgcttattggccatttgcatgccttctttagagaagtctctattcatgtcattagccccttttttaattgggttatttcattttttgttgagtataggagttctttatatactctggatattaacctcttattagatacatggtttgcaaatattttctcccattctgtaggttaccttttcactcttgtttcctttaatgggcagaagttaagtttgatatggtctcatttgcctgcttttgctttcattgtctgtttttggtgtcatatccaagaaatcattgccaaattcagtgtcgtgatgctttttcccggagttttcttctaggagtttttcaggtcttatatttaggttttatcaactacattacgttttatgttgaagaaaaaacactggaatagaattaatgtttaaactgataataaaattttcttcccccacaaaacaaaccaccctgaatataaatactgtaaggccactctgtgtgcttgggaaagttgactcagaggtgtcagatcctagtgaaacgattagattttaaagataaaagaagtcctctcgggccaggagtggtggctcatgcctgtgatcccagcactttgggaggctgaggcaggcagatcacttgaggccaggagtttgagaccagcctggccaacatggcaaagccccatctctactaaaaatacaaaacttagctgggcttggtggtgcacacttgtaatcccagctacttgggaggctgagccatgagaattgcttgaacccaagaggccagggttgcagtgagccaagatcgcaccactgcactccagcctgggcaacagagcaagactgtctcaaaaaaaaaaaaagtcttctcagcctccatgcaggcttacacaagaaagggaaattagatggtgtcagactttttaacagcactaatactaggaagttaaataagttgaataattagaaaacaaaaatgataaatttgaagaaggatggcaacatttttaaactactagaaaacctaattaatgtagaaagcacaaatgcatgtaataaataaggtactagtcatcaaaagaagaaataggttgggctcagtgacacacacctgtaatcctagcgctttgggaggccgaggcaggaagatcacttgagtctgggagtttgagaccagcctggacaacatagggagactccacctgtacaaaaaaatttaaaaatcagctgggtgtggtgttgcatgtctgtggttccagctgctcaggaggctgaggtgggaggattgctgcagtgagccataaatgtgtcactgcactccagcccggccaacaaagtgagaccctgtctcaaataaataatcatctatttttcacacactctggaaatacgtgagaaaatctagctgcaattgtcaattttctgcattcaagcctttaattttaaaaaagtgaattttctaggaaaataattcaccaaaactgaccttaacagagatatataaagttcaaacagacttttttttttttccatagatgaactcaagaaaattgccacagagctgcccccctccctccaaaaaactccaggtccagttgagtttaatagctattagccttaaacactagatacttccagtgttccttaaactttaccagagcataggaaaaaaaaattaaatgatttttatgtagtgagtataatgttgctatcaaaatccagtaggttgtacacacacacacaaaacaatcttgcttaaaaatatcaatggagaaaacaaattatttgcaattgaaatccaccaacacgttaaaaaataacatcatggccgggtgcagtggctcatgcctgtaatcccagcactttggcaggcccaggctggcaaatcacgaggtccagagatcaagaccatcctggccaacatggtgaaaccccgtctctactaaaaatacaaaaattagctgggcgtgatggcacatgcctgtagtcccagctgcttgggaggctgaggcaggagaattgcttgaacccggaaggcggaggttgcagtgagctgagatcgcaccactgcactgcagcctggcgacagagcaagacgctgtctcaaaacaaaacgaaacaaacaaaaacatcgcgaccaaatgggttttattccaggaaatgcaaatgtatgtgtcaaacaccaaaatctcagtggcttaacaccaagtatatttcttatgctgcatgttcagtaaataccagtatggtggagtgtggggagggggtgatgcattgctgtggataattaattactccacaccatcttatgatccttccttctcaacgcaaagcaaggaaagagaacatcaagcgttaagtcctggctcccaaatgtgccacccagaacatatccaccacgagtactcaaatttcactggccaaagcaggtcatttagccatgtttaatttcttagtatttcatttttagttatttagtatttctatttatttatgactgtatgcccttgtgtgtgtgtgtgtgtgtgtgtgtgtgtgtgtgtatggtggtggttctaggaattacaatatatatccttaaaatattacactctggggggtcgcaggcaaaaaaaaattacagtctgccattaattaattctacaatacttcacatacaatgtcagaatgctaccataacagtataactctgtttcccctcggttggtcttttgtggtattgtcatgtattttatctactattatgttgtgaatcccataacagtatgaattttttttatgtagtagtcttctagagaaatgtaaaaagatggtcttggttgggtgtggtggctcacccctgtgatcccagcactttgggaggccaagatgagaggactgcttgagctcaggagttcaagaccaacctgggtaacatagcaagaccctgtctctattaaaaaacaaacaaatgcctggcgtggtggctcatgcctgtaatcccagcactttgggaggctgaggcgggcggatcatgaggtcaagaaatcaagaccatcctggccaacatggtgaaaccccatctctactaaaaatacaaaaattagctgagtgtggtggcacatgcctatagtcccagctactgaggaggctgagacaggagaatctcttgaacccaggaggtggaggttgcagtgagccgagatcgtgtcactgcactccagcctggtgacggagcgagactccatctaaaaaaaaaaaaaaaaaaaaaaaaaaaaaaacaaactcttagctgatggtggtggtgcacgcctgtagtcccagctactcgggaggctgaagcgggagaattgcttgaacctgggaggtcaaggctgcagtgagccatgattgcgccactgcactccagcctgggtgacagaggagcaagaccctgtctcaaaaaaaaaaaaagaaaaaaaaagatggtcttcagcactaacctgcaagttggccctttccagtacaggagagtagggatggagggaggtcatttccttgacgctagtctctcagcttggacattcctctgaggaatgcttaacaggatgagggagggggcttcgcctctggccagtgcccagcttaagtagccttttggaaaagttccagaggacatggagtggggtggggttctgcaggcagccattcctcagtctacacaaccctctggttccacaagaattgggagatgaatttggctgcctgcacttcccagcctgcatcagttttttaaatttttatttatttattttttttttagatggagtctcgctctgtcacctaggctggagtgcagtggtgtgatcttggctcactgcaacctctacctcctgggttcaagcgattctcctgcctcagcctcccgagtagcttggactacaggcgtgtgccaccatgcctggctagttttttgtatttttagtagagacggagtttcaccatgttagccaggatggtcttgatctcctgacctcgtgatccacctgcctcagcctcccaaagtgctgggattacaggcgtgagccaccgcgcccggcctgcatcaggttttgatgagcacgtggccaggagtagggtagtgctgtccagccgatcccctgcccggggaacctcctgtggattgcctggcattgaggttgatcgtatgccctagccaggacaaatttctggaaacccttttgctttagtcatgggggcagggctttacccactgatactccccagcttgcaatgcttcagcaataatctggactgggtttcatcacaagtggtgttaagtctccaaggctttacatttggactattaataaccgtgccctggttatcaatagaaaggggcactccaagagtgtgaactaggtcctcgtgttgatggtgattctgccagcctttgctacaggcattcctttagccattcagagaagatacactcaaatgctacagtatactctaagatatgaataaaatggaccaggatattttcagaaggccccaaaggagaggatgacttgccctcattttcttgacaacttttctcacatctgggcctgtgcaataagaaagctcttacaaaactgctgagacacactgggaaatccagggtataccgatcacatccagccagttctggcactccttggtgtgtgccaagctaggggctatgggaacagggtgagtgggtagatcctttgatgccactccaaagctttctggggagcaccaaaatgacaggaatgcaaaatctctgaaggctcttttctgaattccaagctgactctgcagaagggccaaacttaaagaagcggcccaggctgagcgcagtggctcacacctgtaatcctagcactttgggaggctgaggtgggtggatcgtctgaggtcaggagttcgagaccagcctgatcaacatggtgaaatcccatctctactaaaaaatacaaaaattagccgggcatggtggtgggtgcctgtaattccagctactttggaggctgaggcaggagaatcgcttgaacctgcgggggaggaggttgcagcgagctgagatcacgttacttcactccagcccgtttataagagcgaaactccgtcttgggaggcggggggggggggcatgtgggaagaagccacccgaggagcctggtagggtgatgaaagtgagagcagaggtgtagctcagggccgtgcagcacctcggctttggctctttgcaggctgtagaagcagaatcgtaagacttctcctggcttgtttctttccatttctcgatttgactcctcagcctgctcttctggctccctgctgtctaatggaattccagagcttgaccttgagaatgcagattctcccgattgacaacttctagagaagggaatctcagaaagacaaaggagatgttccttcttccgctgcaagagtggaaaagcagacactctcctgagagcctcataaagctggtgaaagcctgttctgataaagcacccaggagatcattccttccgccccctgctcccaggacaggcacttaggtgagaatgtgtgactcatccagttctgatacctgctgcaaatggtatatgaaacaaaggaatcttttaagccacctgggcttcaaagaaatgtaactgtgtacttttttttttttaatctgcttttaaattggtaaccttgcttaattgcatgttgccctggtaataaccttgcaattgacatctctttttaaaaaatgaaggtctacaatgtctgtattggccagaagagctttgcaagtttctttgttcatctttctcctatgactatgattttcttcgaacaaagagtttgagaggccttgcttcgttttaaattaacaatacatactttgcatatttgacttgagaattgtgtgtatgttatacactactacaaaacaaaccaatttcaataaaaataaaagcacaatccttaaaatcaaagcaaagtgaaacaattgaacctcattatatatcaagttggtggtttactcacacggagaggacttattttaagtgactttaattaggtgactttattttaagtgactttccatggtagttggaaaaaaagaaaccacagtagttgaatgtatatctttagtgggatatattctaagaacaaaaaataaccgcacagtaagaaatcttactgttttcagtaattatgttgttagtaatggcattggtatgattattctgaagatataaatatgtgtgtatatattcaaataatgttaacattgttagcaaccaagattttcagtataacaagatataaaaatataaaataaaaactgaaaaatcatataatcctaaatttgaattgcacgtatccatatgaacacatgatgtattttctctttacaaatattaattaattagcctagaacaacaaacagccaatcaaacaggcaaatcacctgaggtcaggagttcaaaaccagtctgaccaacacagtgaaaccctgtctctactaaaaatacaaaaaattagccaggcgtggtagcaggcgcctgtaatcccagctgctagggagactgaggcaggagaatcgcttgaacctgggaggcagaggttgcggtgagccgagattacaccactacactccagtctaggcgacagagtgagactccatctcaaaaaaaacaaacaacaacaaaacaacaatgacaacaacaataaaaccctcaaaattcaggagtccacttgaaggggctcccgctggcccaggaatgggacaatttgagcatctgaaaaaataacagtgaaaggttgaaacatactaaaatctatgaattcatcatggtcacctttggagaatgctagggaaccagttcatcattctgaaactaggaaataaagggcaaaagcaggcatagatctcacctttcttgtagaaactgtacctcatggcaaccgaacagataataagggaatgtttttctttgtagaggatttctagctaaacaaatgaaaacagaatgatgaaatacctaccaccattttctctttctttcttttttttttttttgagacgcagtctggctctgtcatccagggtggagtgcaatggtgtgatcttggctcactgcagcctctgcctcccgaataccaccattttctagctcctaatgaaataaaggcaagagacaaattcttcatcaatgacagctaaaaaccactcggtgaagagttgatggaaggctgggcacagtggctcatgcctataatcccagcactttaggaggccgaggcaggtggatcacctgaggtcaggagttcgtgaacagcctgccaacatggtgaaaccccgtctatgaaaatacaaaaattagctaggcgtggtggcacaccccagtagtcccagctacttgggaggctgaggcaggagaatcacttggaagttgcagtgagccgagatcgtaccactgcactccagcctgggtgacagacagagttggtctcaaacaaaaaaaaaaaaaaaagaaaagaaagaaaaagagttgatggacatctttataatggatggatattatgtgcctcctggtgtgatacaatacgacatactgcacatcatccatgaagaattcttaggaaaaaatttgaacctgaatgtgatcaagccactaaatttaactgccattttactagaaattctggggacagagaaacatattatgaattagcatcccaacaggaagcagatgggatactcaggttaggagaatgagatgtgaaggcagggtgtaaagatggtgcagggtcctgggaaggtcctcagagaagcctttacaataggaaaggagaggctacccaaatttggaaggagaaagagttgtatagaacagttgtgttgagagggacacagcttcagtcaagaagcacagccaaaccaaggtggccttgccaggagggagacagggaaatacacgccccaactgcattgtcctccctccctcccacacctgccagggctccctattggccaaacccatctgaagccagagggcaagagagcgcagctgatgtaattcacacatggcagtctccaagggcaaattcaaaggtcagagtggagaagggtagttgctaaatgggacaaacgagtacagtctgtcacaaacatgataaataacaccacagggctgcaaacagcaaaatccagaatgcagaaaactctccaggacaaatagcattttccccccaccaaacaaattgcaaagggggaaaagagagggagaagatataaattaaaagaaaatttaggccagtgcggtggttcacgcctgtaatcccaacactttgggaggcgaaggtgggcggatcgcttgagggcagaagtttgagaccaacctggacaacgtggtgaaaccctgtctctaccaaaacatacaaaaaaaaaaaaaaaacaaaaaacaaaactagccaatcgtgatgatgcacacctgtagtcccagctactcaggaggatcagatgggtgggtcgcttgaacctggaaggcagaggttgcagtgagccgagatcatgccactgcactccagcatgggtgacagatcaagacttggccttaaaaaaagagagagagagagagagaaaagaaaaaagaaaatttaaaagcataacaaaaatataaagtgtggaccttgtttggttcctaattctaataagccatgtttgataaaagaaacttctgagcaaatctggcaaatgtggatatttaataatatgaaagaattattgatagtttttaaagatgtggttgtgatttttgtagttttatggagggagagagagtgagtgagcttgtcttatagagatgcatattgaaatgttggcagctggagtcatatttgggatttgctccaaaataggcaaaggcttatagataaaacaagagtgagtgaccgtgtgttgattgtcactgaatatgggggaataggtacacaggggctggttatacttctctgtttttgtgtgtgtttaaaattttccattaaaaaaattaaaaagttgagccaggcacagtgactcatgcctataatcccagcactttgggaggctgaggtgggaggatcccttgagcccaggagtttgagactagcctgggcaatgtagcaaggcccctgtctctacaaaagcaaaaaaaattagtgaggcatggtgacccagctactccggaagctgaggtgggaagattacttgagcctgggagatccaggctgcagtgagcagtgattgtgccactgccctttggcctgggttgcagtgagactgtctcaaaaaataagataaaaagtaatgacactcttgtctagccttgttttgtttatcatatagcaatatttcttggatatcactcagtagcagtgcgtagtgagctgctgcttaaaaaacaaacaaacaaacaaaaacccaggagtctcactattgtttcacaggctggtctcaaactcctgggctcaagcgatcctctcacctcggcctcctgagtagctgggattacaggtggggatgcttcttccttgtctctttataatgtatgtctgtataaattatatgtgtcacaaacacgataacgccatggacatgcaatcagcatatctatgacatatacatataaattttactcaaacggtagcatactatggcttaacaatatgtcttgaagatcactccatgtcaatacaaaccaagcttctgcttttttcccttatcttaatattatttttcatggataatgcattgaaaatctactctccaaccttggctcttctttttttttttttggagatggagtctcactctgtcacctaagctggagtgcagtggcacaatcttggctccctgcaaccttcacctcccaggttcaagcgattctcctgtctcagcctcctgagtagctgggattacaggtgcccactaccatgcccagctaatttttaaatttttttttagtagagatggagtttcaccatgttggccaggctggtctcgatctcttgacctcaagtgatccacctgcctcagcctcccaaagggctgggttttcagatgtgagccactgcgcccggcctccttggctcttttctcttaagaaacggatgagaattgcaaacattttcctatgatggtatttgtcttttaactttgttggggtgtttttccactcagattcttttcgtggacttaaattgcttttgggttttatgtcatactttaaaaggcctcactcactttgagataacaaaaaaaaaatcctacgttttcttttcacatatgtggttttttaaaaatcctttttgggctgggcacggtggctcacgcctgtaatcccagcactttgggaggccgaggcgggcagatcccttgaggtgaggagttcgagaccagcctggtcaatatagtgaaacctcgtctctattaaaaatacaaaaattagccaggtgtgctggcgcgggcctgtagtcccagatatttgggaggctgaggcagaagaatcgcttgaacccgggaggtggaggttgcagtgagccaagatcatgccactgtactctggcctgggtgacagagcaagattccatctcaaaaaaaaaaaatcctttttggtaatacatacacacatataatgatataaaacataaatgtacacccaaacaactgtggctaaatgaacacctgcatgaccaccaccctctgtggtcaagaaatagaatactgctgccaccctagaagcctccagtatgatccatcttccctcattaaaatccactccttcctccttagaagagaccattgtactgatgtcagtggtattctatttcatgttccttatcatgttgctacctcattatgcatccctaaacattattctgttgttgttgttttgagacagagtcttactctgtcagccaggctggagtgcagtggtacaatcatgagtttgaggctcactacagcctcaaactcctggactcaagtgatcctcctaccttagccttctgagtggccagggctgcaggcatgtgccatcatgcccagctaattattttattttttgtagagacaggggcctccttttattacctaggttggtctcaaattcttgggctcaagcaaccctcctgtcttggcctcccaaagctctgggattataggcatgagccactgaacctagcccctaaacattgttttttgtttgtttgtttgtttgtttttgagacggagtctcactctgttgctcagactggagtgcagtgatgcaatctctgcaacgtctgcctctcgggttcaagtgattctcctgtctcagtctcccaagtagctgggattacatgggcatgccaccatgcgcagctaatttttgtgtttttgtgtgtgtgtgtgtgcagatagggtttcaccatgttggccaggctggtctcgaactcctgacctaaggtgatccacccacctcggcctcccaaagtgctgggattagaggtgtgagccactgcacccggccaacattgtttttaagatccattcatgttgtgtgtagctgtggttcattttcattgctttgtagtattttattgtatgcatgtaccataatttatttatccagttggaatttatcctggcaaagatttgcagtaagtctccagctgaatttcttttcaggcgactagccagttgcaccaacaatatttagtgagtaatccgtcttttctccactaatgtaaatgccacttttattatttattaaatgaccttaaatattgtggtctacttccagacttgctcttctgctccattcatctttctatttctgaatttgcaatgaacagtttattattgtcactttataatacactttaagatctggcagagtttgtctcccgcatttctctttctttttcagaacttttcttgatttccctgcatgatctttggaatcagcttgtcaagatccaaaataatcctgttggtatgtttgtttgtatcccattaaaattatagatgaaaagatagaaagatggtatcttttcttcaattgactcctctagccaaaaatggatatgactttttcctttattcaagtctcatggcacataatagcctttgaaagttttagtcatatagttcctgtacattccttgtgaagtaactcattcatttaaacatttgaatagtattctattatatttcattccatggtttatttaatcattctatctttgaatggcatttgaataaatctgtttccaagtttattctgttacatatagcactgcaaagagtatccctgcaaaaatatgtatttggaaatgatgttactataaatgaagttgatggaccaaaggattttaaaaatataaaataataagataataaaggtcatgctaatataaaaataaacaagaaattaaagaacagtgtgttattggtcaagtgtggtggctcacacctgtaatcccagcactttgggaggctgaggcgggtggatcgcttgaggccaggagtttgagaccagcctggccaacatggtgaaacccgtctgtactaaaaacacaaaaagttagccaggcatggtgacacacacctgtaatcccacctactcaggagtctgaggcacgagaatcacttgaacctgagaggtggagattgcagtcaggtaagatcgcatcactgcactccagcctgggtgacagagcaagactctgtctaaaaatatatatataaaaaatatataaaatatatatatataatatatattatatataaaatatatgtaatatataatataatatatatcatatattatatatatagcatgctatcatgtaaaaaaagaatatgaggataaacaaaatataccaaaataagggtaaaatatgtaatatccttgtattaagtagaggatcatagcaggaaagtaaagtgattattatggtactattactattacactggtcttgactgcaaaatcatttcctgcctgtccccaggctggaggtcagaaatggcaaagctgccaccattaactctgttgaggttctacttcagggctttttttcactgaggtggacacctggaaagcctccactacaggcccatagccaggcaagggaatggaagctgcccgagggctccagctgctcactgagttaacatgtgggaggtggaccacagcaactatgtggggaaaccctgtctgcacactgaatcccagcagaatctagcagagccaagagctgagtaacacagagccccaaggacatcatgtgagaccctggatccagcctcacctgaggatgtttcagagcagagttctctaaggcacaagctacaagtgagcatggctgtaacaggcccaagggggcaccagaactggggagaggggcttggtgcctcaaatattgactgctttgggaacggcaggagtgcttgagcggtggacaccggcagcagcagcgaggcccctctagaagcctaagaagggcgctggagcagaaggggacacacagcaggggattggttatctattgctgcataacacccaccccaaaacttagctgcttaaacaacaactattgtatttgctcaggattctgtggctcagcaattcatgctgggctcagctgggcagttcttctgctggtcatgccagagtcactcatatgtctatagtgatacggaacttaacaggggcaggcagtccaaggtggcctcactcacatgtctggggcatcagctgggattcctggaacaggttgagtggctggattattccgtgcatgtagcctctcatccttaaggagtctactccgactttattcacaaggtgacagtgttcctagagaaccaggccctgtgtatacaagcatcccaagctcctgcctgcctcatgtttgctgatggcccactggccagcgcaagtcacatggacaagccccaagtcagtgtgagagggggctatgcataggcgtggatgtcaggaagtgtggtccattggactccattaatgtcatgacgttgccatgtaatatacaatgcatgcttggccctcagcctatgtctaagctcaggtgagaccttccctgggacagcccaagcataagcaagtgagcctggcaggtgagactagagctggtgcaacctgcattaatgaggggattggtgctttgataggattaaaccaggggctagcatagcacagaggagggggcttaaccaatgccagggctttcagaggccctgtggctagaggtgacaaacacagtctctcaaaccaggcagacctgggttcaagtcttcactctgccatttccttcttctgtggtcctgggctagtaactcccctactctgactgtcagtttcttcatctgtgaaatggacctcacagggttgctgtgagaatcaaaggagctcagaagagcttagcctgacacaaagcagcagtctataaatggtggtgctagtgatcagtgtgataagagtggtgataaacatcatggtccctgacattggtgacaggaggcagggtcatggatgttctggatgagcagagagctctggataggtgactaggagtggcctgttagaggagggcagggaagggcatcccaggcagagagagcggtgcatccaaaggcgtggaggtaggattgagaatgatgtgcatgaccaactgcgacaccatcggtgtgtgcagtgtgcctcgaggacgggtgccatggcagaccgcattttcccaagacagatatcgcctatatatcacatgatcgtctgacaatgtggctgttaggagcagaatcatgttcccacaaatatatacgttgaagtccagtacctcagaatgtgactgcatttggagatagggccttaaaagaggtgattggccggacgcagtggctcacacctgtaatcctagcactttgggaggccgaggaaggcagattgcctgagctcaggagttcgagaccagcctgggcaacacggtgaaaccccatctctactaaaatacaaaagaaattagccgggtgtggtggtgtgtgcctgtagtcacagctactcaggaggctgaggcaggagaatcgcttgaacccaggaggtagaagttgcagtgagccgagatcatgccactgcactccagcctagacaacagagcaagactctgtctcgacaaaaaaaaaaaaaaaaaaaaaaaaagaggtgattaagttaaaatgaatgcgttagggtggggctgtaatccagtatgactgtgttcttataagaagaggagacaccaggcatgtgccacacagaggaagaaccatgtgaggacacagtgagaagacagccatctgcaagcccaggagggggtccttaggagaaaccaactctgcccacaccccatcttggatttcttgcctctacaactctgaggaataaacttctgttgcttaagtcaccctgactgtggtcctttgctatggcagccttagcaaacgaatatattgactttgacatccctcccatcaaagggtgtcctatttctcctctccttgaaactcacacttgagcccaaccgccatgctatgaggaagcccgagctagcccagcagccatgctgtgcctgagctagcctagctgccatgttgttcctgagctagcctagcaaccatactaggaagcccaagctagcccagctgccatgctgtgaggaagcccaggctagcccatgctgtgaggaagcccaggctagcccatgctgtgaggaagcctgagctagccttcacggagagaccacacagagagacccttggtaggggttgcagctgacagccatcatcaatacccagacaggtgaatgaagacacctccggatgattccagctcccagctattgagtcacccccccctccacgtccccacccccagctggtgagtcacccccagccaacaagtatttccacctgaggcccgggacatgtggaaaagacaaactatccctgcttcaccttttccaaatttcagacctacagaattcataagcataatgaaatggttgttttacccctctaagttttggagtagttggatacaaagcaatagcatctcccaagggctcttctagatggagcagctacccacagcctggttctgtttttgacgtaacagcgtagaacgcccctctcccgagcactcccgaactttgagagagacctgatactgccacttggtggccaatagaaactatgcaagacccgctgtttcgccctttcttcttccttaagagtttattcacattcattcattcattccacattcataatccctgatggtggtggatcaagtgtagttttaaaaagcatattcgaaaattactttttttaatatgctttcatctttggtcatgaaatttcatttacaagtctacaatcccttacactcttccaaaatccaaaattctctgcaaactcaaagcgtttgcatcagtttataaaagcttactcagtagctaaatctaatccgaactggcttaaggctatttatagtctttcattaacatttcacagtaagattttttttttaatttttttttttgacggagtctcactctgtcgctcaggctggagtgcaatggcacgatttaggctcactgcaacctccacctcccgggttcaagtgattctcctgcctcagcctccccagtagctgggattacagtcacccgccaccacacccagctaatttttgtatttttagtagagactgggtttcaccatgttggccaggctggtctcaaactcctgacctcaggtgatctgcctgcctcggcctcccaaagtgctgggattacaggtgtgagccaccatgcccagcccacagtagaaataataatatttgatttgggggtgctgctctagacccctctaaggatgtcgtaaaatagcagtagttctcaaagtgtggttctgagaccagctgcattggcatcaaatgggaaatggaaatggaaattctcaggccccacttcagacctacggagtgagtgtggcccagccctctgtgctttaacaagccctcttggagattctgactcacgctcacatatgagagtcactgatatagactctatgcacccaccacattgcatttataaaattcaaaaaattgtgaaattcctaagcacatgtagtcccatgctttatgaaaaaggattgctttcagacctgtattttggaatgtcaagtaatattaagggaagccatgagattttcatgtctaaaaaggggggaaggggccaagcgtgggggctcacgcctgtattcccagcactttgggaggccgaggcgggtggatcacctgaggtcgggagttcaagaccagcctgaccaacatggagaaaccccatctctactaaaaatacaaaattagccagccatggtggcgcatgcctgtaatcccagttactcaggaggctgaggcaggagaattgcttgaacccgggaggaggagcttgcagtgagccgagattgtgccattgcactccagcctgggcaacaagagcaaaactctgcctcaaaaaaaaaaagggggggcagtggggaaggagttccttgtaggaatggagaaagggtgtgattaataacaataaaagctaacttttgctgagttatttataacctatcaggcactgcgccaagtgcctatgcttatctagtccacataatgcacctaggagatagttacttttatcatacccattttatgaatggggaaactgaggcaagtggtgtgagcacctaccaaagcctgaagaaggtcagcagtagaagctgtggccttcagtagagggacacagccaactcacatggcctcacttctgccctcttatctcctacaagaagccagaagacaagggaattcctatggtgtcatccacagtagtgcagagcaagatgaagtatgctactcaggcctccaaatttccctccaaaacaactgcaccagcgtttggttcctcccaccccaatgggttccacttacacagtcttaggtctgtagggctagtgaagacagccagcctatcatttattatgcctctagtgcaaatctgggtatcacaaatgcatgctattgtggttataaaatataaaagtatcagccgggcccagtggctcatgcctgtaatcccagcactttgggaggctgagacgggtggatcacctgaggtcgggagttcgagaccagcctggccaacatggtgaaaccccgtctttactaaaaatacaaaaaaaaaattagctggacatggtggtgggtgcctgtaatcgcagctactcaggaggctgaggcaagagaatcgcttgaacccaggagttgaaggttgcagtgagccgatattgtgcccttgcactccagcctgggcaacaagagtgaaactccatctcaaaagtaaataaataaataaataaatataaaagtatcacactgtaagtgttcatttgcagcttgcattttttcccaactcattttgttttttcagatttatctatgttgatgcaggcagctttatttctgttcattctctctgttgtttagaattctgcgatattaaagcactcctgaatccatttatccattccccctttggtaggcatttaggatgttgctggccttttgcagataaaggcctaatgaatatctttagacatgtcttctacacaggtgggaggttttctcctagctggatgttcctaaatgtggagctgctgtattactggacgcgagtacccaactttcccaaataatgccaaatttccctccaaaacgattgcaccagggtttggttcctcctaccccatggggttccacttacacagtcttagcccaccgcggtattgagagactattttatttatatttattttgcctttccgatggatgtgacctctacctcctatctgttttatttacatttccctgataattcagaaatggagcatctcttcaacccatctgtcatgtggggataaacattttgcctttccacttcaggctttgcctatgtacagttgacccttaggcaacatgggtttgaagtgcacaggttcacttaaacacagttttgtttttgtttttttttcaataaatacagtaggctgcccatatggatgggttctgcatctgcaacccaatgcggatggaagataccatatttgccggaatcctgcaggactcctgaaattttacgcactgattttgggaaccagagtcctctgcagataccgagggatgacatatcttccaagcatagatttctagaatttcaaaagaccttccctctcttattccaggcagtaacacatgaaaagcgcttcggctttcaggctgcctcctgggctgtgggtgttccaggctcaattttgccactcaggcctgaggaacaattttgtttgctgtcgctggcatctgtccttccccagaggcaaagagtgacaatcgcgagatgggtgagagctgagggcaaccacagtagcagcgcaacaaaacaaatgcagaagggaaggaaacctaacccacatttgtaatttccaaaatattgtcttgctgcattttcaagctctgtttattaaagccctgatgtatgccaggagtatatttctctatcctccaaacacttccaccagcctcctaaagcagggtcacttcatccctacaacaaattcttgctgccaggcacagtggcccacacctgtaatcccagcactttggggggtccaagcaggagggcttgaggctgagttagaagtcagcctgggcaacatagtgagaccccatctctacaaaaaaattttgttttaattagccaggtggctgggggtggtggctcatgcctgtaatcccagaactttgggaggccgaggctggaagatcacttgaggccaggagttcgagaccaccttggccaacatgacaaaaccccgtctctactaaaaatacaaaaattggccgggcatggtggtgcgcacctatagtcccagctacttgggaggctgaagcatgagaattgcttgaacctgagaggtggagattgcagtgaactgagatcatgccattgcatgccagcctgggcgacaaagcaagtctctgccttaaaaaaaaaaaattgccaggtgtggtgatggcacctgtagtcccagctacttgggaggctgaggcaagaaggtcactgaagcccaggagttcaaggctacagtgaactatgatgctatcgtggcactactgcactccagcccagatgacagagtgagaccctatctctaaaaagtaaaataaaataaataaaaatgtccttgctcttcctatatgccaggctatgttaggcactgggaatccgtgttaagcaaaaaggcctggtgtctgatcagagcgcagggtggcactcactggatcaatgtcctggggctcccataacaaaatactgcagacttggtggctcagacaatttcctcacatttctgggggttaggagtctgagatcaaggtgtcagcagtgctgccttctttttctctctccttggcttgtaggtgctgtcttcctcctgtgtcttcacagtgtcttttatctgcctccaaatctcctctaataaagacattggtcctactggattagggtctacccatatgaactcatttgaccttagtcaccttcttttattcttttttattcttttttttttttttttctgagatggactctctctctgtcgcccaggctgaagtgcagtggcacgatcttggctcaccgcaatctccacctcccaggttcaagtgattctcctgcctcaggttcctgaatagctgggattaccggaatctgccaccatgcctggctaatttttgcattttttagtagagatggggttatgccatgttggccaggttggtcttgaactcctgacctcaagtgatctgcctgcctcagcctccctaagtgctgggaatacaggtgtgagccaccacacccagctccttagtcatcttatgaaagaccctatctctgtatgcagtctcatgctgaaatactgggggttaggacttcaacataggaatttgggagtggtgggactcagttcagcttataacactgtctaatgggagaagcaggattaatattcaatgccacaacgatgtacaaaatgacaactgtggtccctggggttatgagagctactaccagggggtttggctgagtgggctctaggaaaccttccctgagaaagtgatggttgagctgagacctgaaagaggttgggggctaagcagagggagggaacagcaggccaggtgtagggacaagatatgctgcagggctgggaataccccagtaggcacatgaagaccaaaggcattaagcggcacaggttgctgaggggggacttctgggcactatgttggagatggtggcaacttaccccaggtaaaaatcaccagagcactcttttaaaaatacagatcccaggcctcatccaggtctgctgaatcagaatggccaaggggaagggcccgagaatctgcattccctcacaatttttcttattttgaaaaatatcaaatctagagaaatggaaagaaaagtacaaggaacacctgaacccccttcacctagactcaccagttgttaacattttggctcatttttgctttctctctctccctccctcactctctcctcaccaagcatctcctaaaaataggggcctaggccaggtgtggtggctcacacctatcatcccagcactttgggaggccgatgcaggaggattgcttgagcccaggagttcaagaccagcctgggcaacatagggagatcctgtctgtataaaattatttttaaattagccagctgtgggccaggcatagtggctcatacttgtaatcccagcactttgggaggccgaggcggacggatcacaaggtcaggagatcaagaccattctggctatcatggtgaaaccctgtctctgctaaaaatacaaaaaatgagccgggcatggtggcacgtgcctgtagtcccagctacttcagaggctgaggcaggagaatcgcttgaacctgggaggcagaggttgcagtgagccgagatcgccccactgcactccagcctgggcaacagggcaagactctgtctcaaaaaaaaaaaaaaaaaaaaaaaattagctcccaggtacgtgggaggctgaggtgggaggattgcttcagtccgggaggttgaggctgcagggagttgtgatagcaccactgccttccagtctgggtgacagagtgagaccctgtctcaaaaaacaaacaacaaaaaaggaccttttcctccataaccacgaccagaacaccgttgtcatatttaagaagagtaatgtcaatccagtaatgtcatctaatgtacagataatatttaaattccctgtggtttacaacatttctttcatagctatttacttgttcagtccaagagccaatcaaggtgcacgcattatgcactttttattgtgtccttttaatctctttcaatctggaataagtccctgccactataaaaaatgatattaacttttaaaaagagagtctaggcttttagaatgccccacattctagatttgtcttaattttcctcatgattaaaatcaggttaagtatttttggcaagaatatgacatagaagatgttgagtatatcttattgcatcacagtgggggcgaacaatgtcaggttgtcccactatggtgatgctgtgtgatctcgcgtttaaggcagagaccactggagttctctgatgtaaaggtacattttccccttttacctagtaaatgatctgtggcatgatgttttgaagagtgtgactgttctgttacccaataccttttttctcaatggctgtagcagctgttcatggttgttgttccctcaatcaattattatattggtgggtgcaaaaaggaatctgcatctttctttccttccttccttccttccttccttccttccttccttccttccttccttccttcctttctttctttctttctccttccttccttccttccttccttccttctttctttctttctttctttctctctctctctctttctttctttctttcattttgagatagagtcttgccctgttgcccaggctggagtgcaatggtgcgatcttggctctctgtaacttccacctcccagattcaagcaattctcctgcctcagcctcccgagtagctggggttacaggcgtgtgccactatgcctggctactttttgtatttttagtagagatggagttttgtcatgttggccaggctggtctcaaactcctgacctaaggtgatccacccgtcttgacctcccaaagtgctgggattacaggtgtgagccactgcacccggctggaatctgcatttttaataagtgcctcaggtgacttttctttgcctggaattttggaaaccccatttaagtcaatataaggaatacaggagaatgaggcattgctaccaaggcagctgaaggcattagctaaagcctattattcattagaatctgctaaaatgcatattctgaggcccgtacaccaaagaatgagaaacgggtgcaaaggacaggcccaggaaggaggattttaatactatctctcccctaccatcctgccaaccgtggatatggtttgtttgttgccaccaaaattcatgttaaaatttgaccttcagaatgaaggtttggggatgtggcacctagtgggagatgtttgagtaatagtggcagatctctcaggaataacttggtgctgttctcccagtagtgagtgagttctggctctggggagactggaatggttgttgcaggaacggattatttcccacaagagtgggttgtcataaagccagcacagtcctcaggtttcccctttttgcacatgtctgtttcccttttgaccttctcccttctctaccatgttgcgatagaggaaaacccttgccagaagcctgggccatgcccttgaacttctcagcctgcagaaccgtgagctaaataaacctcttttctttataaactacccagtctcaggtactctcttatagccacagaaaatggactaaactccctctcccatttcctacccactttgtggtcaccaaaacttgtgaaacactgacttaggtggtgattcttaatcctggctaagttaagtgaagttgcattttcaacatgccttgggagttcttttgatctgtatgtatgtttaaaaataaacctccagagattttgattcaaagggtctggggtagaacccagccatcagaaaaatttaaaacctcttagtgattccaaagtaccaccaagactgagagccactgcacaagattctccataaattgaatataaaaatgaaagccagctgggcacggtggctcacacctgtactcccagcactttggaaggccgaggcaggtgcatcatgaggtcaggagatcaagaccatcctggctaacactgtgaaactccatctctactaaaaatacaaaaaattagctgggcgtggtggcaggcacctgtagtcccagctactcgggaggctgaggcaggagaattgcttgaacccaggaggcggaggttgcagtaagcaaagattgtgccactgcactccagcctgggcgacagagcgagcgtctttctcaaaaaaaaaaaaaaaaaaaaaaattgaaaaccagtctatcccactcttcgttacccctatcctcacagcatcacaggttgagctcaccactagccttaaatgcctggggctccttccacctacttatggggctcctactgtgtgcaaacagctcttggggagcttacaaaagaggtaaaagtcacttcccacaaaagcatgaggacgtgggaaaaaaccacacatacaaacacttataagtattgtacaatcagaattgtacagaccaggaaaccgacattcagaagaggaaatgaccgcccagcgagttcatgccagagccagaactcttacctgggatgcctttctccttcttggctcatttttacttgaacccaagttgaaccctctgcacttcctgctcttctgttggttgggcctggcctggagctatcatcttcatcatcaggagtagcagcatggggacaagggcagcctatcaaggcttattctgggtctagcattagactaagtatctgttgaatgaatgaatgaatgtagccagcctagcacctgcccacaggctgacattaagaaccacaagttcaggccaggtgcagtggctcatgcctgtaattccagcaagactgtttgagctcaggagtttaataccagcctgggcaacatagcaagagctcatctgcactaaaagtaaaaataattgagtgaaactcggtctcaaaaaaaaaaaattagctgggcctagtggcatgcgactgtagtcccagctactcagaggctgagatgggaggatcacttgagtgccagaggctgcagtgagctatgctcatgccattgcactccagcctgggtgacagagtgagactctgtctcagaaaacaaaaacaaaaacaaaaacctttgttcaggctgggtgtggttgctcacgcctataatcccagcactttgggcggaccacttgaggccaggagcttgagaccagcctggccaacactgggaaaccctgtctctattaaaaatacaaaaattagccgggcatgatggtgggtgcctgtaatacaagctactcaggaggctgaggcaggagaatcacttgaacccaggaggcagaggttgcagtgagccaagatcgtaccactgcactccagcctgggtgagagactgagactctgtctcaaaaaacaaacaaacaaaagaccttggttcagataacctctagaatgaatccctttaaacactgaaattagttcatttttcacagactcaggaatctctagaccttgcctcatagcaactatataattcacccaaattctaccttctgtataatttttttttttttgagacggagtctcgctctgtcgcccaggctggagtgcagtggcgcaatctctgctcactgcaagctccgcctcccgggttcacgccattctcctgcctcagcctcacgactagctgggactacaggcgcccgccatcatgcccggctaattttttgtatttttagtagagacggggtttcaccgtgttagacaggatggtctcgatctcctgacctcgtgatctgcctgcctcagcctcctaaagtgctggtattacaggtgtgagccaccgcgcgcggcctaccttctgtataatttctatggaactatgaatttacttagttgctgttgaccggttgacctaaagttatgttgacatttaactctatatttttaaacatcagtgtttagattttgtatgttggagcccatttatttatttggcggccctcaaacattttcccatagcctcgtagaatattcagtggccttggactgtcccttaatgtcttactacagatggtaccacagatgacctccaaaataaaggaagagactttcctgcctgtggacaggagagagaggtgtggaggatgagagcatagtttaacttttttttttgaaaaactttattgagatataatccacatgccatacaattcactggcttataagtatataattcagtggtttttaatatatccatagttgcgtgatcatcaccacaatcaattttaaaaatttttatcacctccaaaagaaaaactggtactctttttgagtcaccccccatttgcctccaataaccccctcccagctctagacaatcaccaatctgacttctgtctctatagatcagcctattctggacatttcctataaatacaatcatataatatgtgtatggccttggaactggcttctttcactcagcacaaggttttcaaggttcattcacgttgtggcatgtgcttcattcattttgattgccaagtaatagtggattgtaccgtgttttatttatccattatcatttgatggatatttggattgtttccacttttttttttttttttttttttgagacggagtctcgctctgtcgcccaggctggagtgcagtggcgggatctcggctcactgcaagctccgcctcccgtgttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccttgtttccactttttagctgttgtgaataatgctactatgaacatttgtgtacaaatttttgtgtatgtatgcttttatttctcctgagtatatacctaggagtagaattgctgggtcatctggcaactctatgttttaaattttgaggaaatgccatactggttttcaaagcagcggcaccattttacatttccaccagcaatgtatgaaggatccaatttctccatatccttaccaatgctggttattgcctatcttttttattataaccatcttagtgggtatgaagtggtatctcattgtggctttgcatttccttcattgctaatgatgttgagcatcttggccatgtgtatatctatcttctttgaagaaatgtctatccagatcccttggcctttttttttttttttttttttttttttttttttgagactgggtctcgctctgtcgcccaggctggagtgcagtggtgtgatcttggttcaccgcaacctctgcctcccaggttcaaacaatcctcccacctcagcctccccagtagctgggactacaggcccatgccatcatgcccagttaactttttgtatttttagtagagtcagggttttgccatgttgcccaggctccttgcccattttttattatttgtctctttattatagagttgtaagagttccttatatattctagatataagtcccttaccaggaatatgatttgcaaatatttcctcccgttctgtgggatattgtattattttgccaaggctgccataacataatactatagactgggtggcttaaacaacagaaattggctgggtgcggtggctcacacctgtaatcccagcactttgggaggccgaggtgggtggatcacttgaggtcaggagtttgagaccagcctggccaacatggtgaaacccttactctactaaaaatacaaaaattagccgagcgtgggggcatgcacctgtaatcccagcttctcaggaggctgaggcaggagaatcgcttgaacctgggaggtggaggttgcagtaagccaagatcgtgccactgcactccaccctgggcagcagagtgaaactctatgtcaaaaaaacaaaacaaaacaaacccccagaaatttattcctcacaattctgaaggctacaattctgagatcaaggtgttggcaggtctggtcccccagccctgagtcctctctccttggtttgtaattaaccttcttctccctgtgccttcctctggtctttcctctgtgtggcgcatctctagtgtctcttcttatgaggacaccagtcattggatgagggccccatccaagggcctcagtttaagatgatcacctctttaaagaccttatctccatccacagttacattctgaggttctgagactgtaaccagtacagttcagcatatgaatgggggtgagggggcacacaattcagcttataacagttattttttcactctctttttgttctttttatgtttaatttttttttttttttttttttagagacagggtcttgctctgtcacccaggcgggagtacagtagcaccatcatagctcactgcagccttgaactcctaggcaaaagcaatcctcttaaatagctaggactacaatcatgaaccactacgtctgcctaattttaaaagaatttgtagagacagagtttcactatgttgccctggctggtcttgagctcctggcctcaagtaatcctcctatctccacctcccaaaatgctgggattataggtgtgagccaccaggcccagccataacttttcactttcttgatgatacccctgaaagcacaaaagtttttaatttatctatttttttttcttttgttgcttgtgctaatatctaagcaactactgtttaatccaaagtcatgaagatttaggcttatgttttcttcagagagttttatagttttagctcttacatttagatctatatgttgcatatagtatgaagcagggatccaaattcattcttttgcatgtggatatccagttgtcccagcaccattttttgaaaacactattctttccccattaaattgtcttggcactcttgttgaaaatcaattggcagtaagtgtaagggcttctgtctggactctcagttttattccattggtctgtatgcccatccttatacccgtaccaccctgccttgatgactgaagtttcctagtaagttttgaaatcaggacttgtgagtcccccaacttattctgaatttactttaacttttgataccgaacacagtgtgagaggtgaatgaacagcatgacattggagttgggagccccctccctccaaaggccttattttaggaacacaggccccaagtgccacacaagccttggagagatgggttcccatcctctcagcccatggctcttcattatcaatcaatggaaacattcttcggagaacaatgattcccttgggttattttaaacatggctttaagtcttccccacatgctctactgtctaattgcttttcctgaaacagtgtcattcacaactggattattaatgaactgagagggagccagggagccaatgaagggggcttacagagttcctggagagggcctgggggcctggaacaagttcaacccacagattttctctcccccaagaaaggtgactgagcaaacagaaaatcactaaactcaggtgatgctggtggcctcaaaagaatattgccagtgaaaaaaaaaggattcgggcgagttcctcaaacatgacagctgagaatcaaattaactgggtaccatccccaaactccccaaacttaaactctgaatttccccagctggctggccctggggtgcctagggctctcatctgtaggccgggaaagctcaggaaacaaggcctttgtggagaagagaaacctattgttctaaggccagggttcagcaaatgtggattccagagaatgtttggggaggttttctctgctttgtttatgaactttcttttctcttcctggggtggtgatggtggggggtgactctcagcaacttaaatagttaaacccattgtgttgtaaagaaaggctggtgcacagagtgcagaggccttcagccccagaaagaggcttgaatgaggtgacagaagccaccgggtatgttttgctttttatttttagcgttaaatctcagggaagcagcccctatcttcatcctgcacatctcaaagggcgtcagacgtcagcagaggtacgaccacttccttcctccagcgcttcacctcccttctttccagaaagaggaaatgatgcgagtccacaccgcaggccacagcccccatgtctcggccccagcagctgggggacctggccccacagatctgtccccagcgcaaggccagggccggcccctggacctcctgggaagccttcagactcaggccgcgcaggccttcaagctaggaaccctgagttcctggccctggcattcattctgtgtgaccttgagcaggttaccactcctctctgggcttcaggattcccgtctgtcaaatgggagcagggataccgtccttggcttccctctttccatggtcggggtgggggttaggaaaactattttggaggagggggcagcgttaggaaaactattccgaagcctggccacgtcccaaccggtttcaacttcctgcagctcagaagaggggtccccacccgagagcgccgggaccctgtcccgcgctgcctcccaagccggatggggttgagcgcgcccaccccagtcccaggagctcaggccccgccttgggggaggagccgagaggcggcgcggaggctcgcggccgagcagagccagctctgtcgccgctggagcagctgcggctcggggacccacagacacagccggggtcgggagccgcccggggcagggctcgggagagcgggtgagttccccggcggcgccaccaccctccttgcgctctgcggcttcgcagggcgggggatgaggatggggcggggaggtggtcccagcctgctatcacctagctgggggccggggcgctttggccaagggacgatagcttgagataaatgggagtgtggggactctggaaagacgggtaccgagagcgctaggtccgggagtcgggctggaatgggggcgttctccccggcctcgcaattccttgacgaggccaggggagggggcgcattggcaggttgttggctgcggccgtcgtagaccgatcttggggcggggaggtggggtcctcggtctgttctggactcatggggccgccgtctgccgggggtgcaatgccgggcggcgggagccacagcggacaccaaacaacccccccccgcgcactctcccggccgggcatggtggtgccgccccctcgcgtggcggggcttggtcctggcgggcagcggcagggcgcagagagcgctcctgcccgggcgggaaagatccccaaggcaggcgcctccacctgcagacccgccccgcctcaggatccggctgacagcaccagccagcccggggagaccccgcgagtggtagttccccgggaggggcgcgcccggcctctcccagggccccgtgcgccggcggctgggtcccccgcgccaggagcgctcccctctgggcgactccggctcatcgattccggcccagaggagcgcccccgggcgccgaggatgggcggagacgtgcagccgcccctgagaggtcgcccagaggggtctccccaaggtcacccggagtgcccaggctgagctgcccagaccgccccgggtggagagccgggaggcaggcgctcgctgccctcctccttcccccatgtagactcccttcctccgctcccccaccccggcccggcctccagcttcactggagatgctgatgatgcagctcccagcccttggaggataattgagcctgggagagctttgaatctggccctcctgagaccccagggctgcgccgctgccgcgcgccaggcctgggtcccggtgctcccgggcacctcaggagcggagggagagggatgtggcttcatcagcgcttctaggaaccgaaaaccgagctgcctgcgcgcccatgtgattgcatttcacataaagggcccctgttttcactgtcagaagagccccccagctctccgcggctctggacaccaggtgccgcctctgaatcaccctctgtggaggacccggggcccggaggtacaggcgccctttcccgcagggctctccctggaaagggcctgccgatggcggcctcagtccgcaggggtacttccctgtgtaccctgccatttcctgcggctggtgaagcaccggagaaaaaccgtccatctaggaggcctcctccaaggctggtaataaagcttcttagcccagccagcgactagctgtctactcgtgggcaaggtacttggcttctggagtctcaactgcctctaagatacggggctaacagccgccaggctgtggggagatgagggagaggctgggtgcagcagagcgggaggatgaacactccttggccaatactggccgccctcgggattggctttgagtggggcgtgtctctcttagacaggtgcagaagtggagccctggtgggtggttctgcaggggctgggggagtttccacatcttcctcccccagctctgtcataaaaagccagcttgcaggaggccggtgggggccagcaaatccttccagccggctgcctgctcacacggcccttcccacacaaatctcccatgcccttctctcccacctgtcacccaaatcccatcttcctggctgagtccccaggatgctgggggcaagatgtcaaccaggccaccctggactgtcaactctgtgcctacttgtctactggggtctacctaacagtgttcccctgtcctggaaccttcctggctccagctcttcccagcctctgtaatgtcttctttcccctcttttggtctcctaccaccgtgacactcattagtggctctgtggttcatgtgtcaagggccccgtgccatctgtgctctccagatcatccatggcctagaaagacacggtaggcaaggccctgtgcccactcagactttgctctccctggtaattgacggagtggaggttaaattctaatctagctgttaagtcatttcaggagcttgagccacagggctaagaggatactgatgtaggcaggtggtttttccttaaagccagaacctttctcctttctgcagagcccatttgagccctttggaaactaggcctatgtgtgatggcctcacagaatcctcacaaccccgtgaagtaggcattactgattcccattttgcagatgggaaaactggggctcagctcctctcaaaaccagctccatgccccaagtgtagcaacagaggctgcagccaacctggtttaggagaaggcagaaggcacatacctgaattcaggtgctgtgcttggactcttgggaccccatccccccaacctttccctcccctctcccaacctagccaccacccctcctgcacccaggactcttgtcacatttgttgaccaggaggtcccaactggcactcttccagcagagaccaggaaaaccttcactgtcctgagtgcatcttagcaattgggcttcaagaagggctcggacaagcctgcctcttacagaaagctacgagtatgaagagtgagggagccagagaggtctaattttaattagggatctatacctaaaagctctgtgaccctgtatacatgacttaatctctctgagtctggttttctcatttgtaaaataggtatcacagtaatgcctactttgtgggattgtaaggattccatgagaccattaacacatagaaagtgctcagtactagggtggagcatagtggctcacacctgtaatcccagcagtttgggaggccaaggcgggaggatcactagacgtcaggagttcgagaccagctggccaacatggtgaaaccccatctctactaaaaatacaaaaattagtgcagcatggtggcgcatgcctgtagtcctagctacttgggaggctgaggcacgagaattgcttgaacccgggagcaggaggttgcaatgagccgagatcacatgactgcactccagcctgggtgacagagcgagactccatctcaaaaagaaaaagaaaaaaaaaagtgctcagtacagcatctggtgtgggtaggaatgcaggaaatgatcattgtcaccatcactactatttcctcctttgtgttggactctcaaaggtcccacctcctccagtgctagggtggggagtgagtgcgaccctgtctcttctgcctgtagccatcaggacggggaaagcctctcagcctgtctcctggggcgggggtgggggctcactcctgggaacttgagtctagcaccagcttttccccggggagtctgtgagcagccacttagcctttctcagctgactgccattttccaggattcattgattcattcaaaagacgtttattccatcccagcccttgtgcttagcaagggatttcaagatgaatgaggcagctctcagagttctccctctatggggagaggcaggcctggagacagataatgaggacactgtgggataaaggctgcaacagcaagaagagagagtgacgagcagatccacatggctcaggctgacccaggtctgaatcttgaagctgccaccttgtagctgggtgaggatggacagaggccttacctctcaagcagataagccacctccctaagatgatgatgtgaggagagaagtgagacactgtggataaaaaacctagcttggaccaggtgcggtggctcatgcctgtaatcccagcaatttgggaggcagaggtgggcagactgattgactccaggagttcgagactagcctgggcaatatggcaaaaccccgtctctacaaaaaatacaaaaaattagccaggcatggtggtgtgcacctgtagtcccagctacttggaaggctgaggtgggagaatcacctgaacgggggaagtggaggctcctgtgagccatgattgcgtgcacctctgcactctagcctgggcaacagagtaagaccttgtttcgaaaaaaaaaaaaaaaaaaaaacaaaaccaaaaaacttaaaaacccagcttgggctttctagatattaataagtgctcacagatgttcgttgctattattagtctattattgccaataacaggtgggcaaaagttgctgtgggagcatgttgagcccttcagtgacagttttccaggtggtagggcagccctagccgggagaacagcatgtgcagaggcaccgaggcttaaaagtgctggatgtttttggagagcagtgggaggagttgctgatggagcagagtcatgagaaagtttgatggaggcagaagcaaggccagggaggtagcagaggctatcctgccgggagccccgaaggattaaacactcactgacccgaggcagtccctctgcaccttccttggagggtggttctctagtgagggttgtccaggaaacttcaggattaacttttgcatgggaggaagggctggtctctgctcaactatccatacattcaccatccttccctcttcattccacccaggaagcacgaagaagaagaggtccactccctcttcctgagatgcttttcccacctctgcacttgtttctctcttcctgggactcagtttctcacctgagagaagagggtagaagtggaggaagcgtcatgacctgactcactgattgatcatgatatagcaccaagtgcatttctggatgctggtcactgtcaaaggtctttacttgcatcgccattgaattctcataccaatccgttgaaatgaatgcacttatcccccactgcacagagggagaaaccgaggcacagagggtgaggcaatttgctaaagggcatgcagcttgtaagtgacaggaactcacgtcttggggggcatctcaaagttgccatgtgctatccttcaccaccttcttcacacactttgtaaatctaaggctgactgcagaatatctggcctcttttgctttgtgtacctttgggcgctgggcagtaggcattttggagatgggtcacagtggggtgtgctctgggtatgtaacctgactttggggaaattcctgggtgcagacgctttgtggggaggtgttcttggatgtctcagaatctagaatggcattccttcgcccacagatgtgccttgatgcaggcaatgtgcagcttgattgatgtggcaagatggtggctgagccccacggtggccccaggaaggaatgaatgaatcttttaggatggctgatcagagcatcacatgaccacagaccctccctgtttcagaggacatccaaacacaggcttacatttccttttacatgggggcaaagtttggggccagggttcaaatgctggctctgcctccactggctttggggcctagggaaattttttcacttccttgaaccttaatttcttcatctggaaataaagatgaagaaataagttgctaattttagcatcttcaataagttgctaaatagtaactcacaaacacaattctgaattgtcataaggatttgtaatcatatggaaaatgcttggcttccaagctgtagataatattgatgtaatatccagcagatttttctctgcagtacttataattgtgattatatggttatatgtgagcattactcttttagtcttctgtttcatccactagacctgtggttctcaacttggggcagtttgaccctccccaggggatatttggcaatgtctaaagacgtttttggttgttacaacttttcgggggatagtgggggagaggagctactgacatccagtgagtagacaccaggggtgctgctaaatatcctgtggtgcacaggagagcacccccacaacagaaaatgatctgatcccaaatatcaatagtgctgaggttaagaaagactacactggacgatgagccccataaggtccgtgactgtgtccaattcattcagctgtgtgtctccagttggccagcgtgatcagcatgatgtccagcacacaggagacaatcaatatgcattaaaggaatgaatgaggacttggaaggccttatgtcccctggagtcccaggggtttagcttgtggaacattttgaataggcagaagagatttagatgaacttgaatgatgaacagccaattagtaactcaggccaaagacattcagaccgagctctctgttttccttcccaagcaggtgcttgggggcccagattatctgaattgttcctgccatcaccactgcattttacccatgtagatacaggacccgtctttatctggaaagtaggctggggcagaggagcataggtgctgtcagctgggcccttgggatttgccaagctggggcacagctgcttgtcagcttcctgttttgtccctttctagtggaatgaaggaaacccactgaatggctattttccactgacatttacagcaatgtgataggccttggattaatgaggtcaaactgcagtgtgaaatctgcctgataacttgaagcttggccaacgggaagacatcgcttgttttctttggaccgtttgatgtccctggatggctttaggcaggaaagcaggggtctcaattctgtacgaaagaggagggtgttttacttcctggaattatagaggccagaggtgtctctttttcaatttattgggaaggtttattttaatatggacttagaaataaataacttattaaagtgaaggttcacctggagccttaggctggctgctaagtgtgagtctgggctgttgaagggactgtgctgttcttctgggtctctgtaggagtttgaaggagaagactggccccaaagggtgtttgaacaggttagatgtgcccattggttagaacttacttggatagggagaagggatctagggcgtatccacaaacttgcatatggatcccctttggtttcctgctaaaatgcagaaactgactcagtagggctgggtatggagttttctgcatttctaccaagctcccagggggtgtcaagctgctagtctgtgaactgcactttgagaagcaagggtatgggagaccccaagtctacaggtgagggttccctggtgcaaaccgcttaagcatgaaagcaaatgcagcctgttgtgcctgttcacacagccatctgctgtgctggctggcttgcggagtcacagatgttcactgtgccccttctctgtgtgcccaggcctgggaccagacttgacaaagacgatgcttggtctcaaggagcaactcagacagccagaatgtcagctagaatgatgagctttgagtactttcaaaaacatgtatccaggtacatggtgttcctgggtcatctggtcacctgggacttgtgagaagtacagatgcctgggccttagcccagtccacctgtgttagaatcagccaatatagggccctgaaagtctgtattttctcaaagtgtgccaggtgattctgattcacagccagactgatggaagggaaggtgggaggaagaactgccagtacatgcaggttaattgctcagcaggacctatgtaaggttgtagagttgtgtattgctgatgggcacagtggcactcggctaaaggagaggctgaaatctagcctgtggatccacttgccaagctctgcaccctgcagggttgcatctgcttagagggacgggcacctttttcttaatattcatcataatcacttggtacttattatgagccaggtgctgtctacttaactcctttagtcctcctaacaactctaaggggtgacatcatcatcatcatcattattattattattattattattattattattattattattattttgagacacagtctcactctgtcgtccaggctggagggcagtggtgccatctcggctcacggcaacttctgcttcccgggttcaagtgattctcctgcctcagcctcctgagtagctgagattacaggcacccgccaccactcctggctacattttgtatttttagtagagaaggggtttcaccatgttggccaggctggtctcaaactcctgacctcaagtgatccacccggctcggcctcccagggtgttgggattacaggcatgagccactgtgtctggccaggtgtgactttagtgctactctgattttactgttcaggaaagtgaagcagagaggttcaatgtcttactcaaggtcacacagccagtaaatggaaaagtcaggattccatttcaggacatccggcttcaaagtccttgtactgaatcattacactctctggccctttctttgcataaaaatgctgtcttctctttatggggctatccctactctgagggagtaccttttttcttgtccttccttcagaggggggaaggctagcaatgaccttggctggctttagagtcaggtacgggtttgattcctacctccagcacctactgcaaccttgagtaagttacatgtgtgtatttgctgagccacaatttccccatatgtaaaacaggaataataatagtataatataaattgatatgattaggcatttagcctctgcttggcaggtaggaggtacctgatacatgccaactattcttatggcattattatcattagagttagtccctaggagtattcaggagctagggaaataggtgagcaaagcactgtgtcattatgtccccaggagctgggtcattcattttgttcactaggttacttatggccattacttacctgggcatccctagtctcctccgcttcttggccccagagtctgtgccagcctggagagttctcagaatgtcttagttcagactcttagtcagaactgcctttgtttcctcacatccaagaacaagtaaaacatacaaattttgacacttattctctttaggtctcttgactctttttggtgactttctctgtctcctgttttctttctggaactattgctgtcgttggctatcccatggactggatagagaggaaatgttgccttataaacattgccaattaccttataaaaatatagggaagattttcaccaaaatgtcattcattttttttcttttatatataaacttaagcttttgttttcctatggctgtatgtcatgctttttaattacacaaagtatataagtgtatcataagtaaactttccccatcttctcagccactcatcccttttccccggaataaatctataaatgttttatgtatttttccataaatttcatatgcatatataaacccatattcatttacatgtttatccatttttctttttaacacaactatacaaaactctcctgagatcttctttttcagctaatttatctgagcacatgccaacacacagatatacctggatctttaaggctatctgatagtccagtgataaaaatgtaccatcatttgttttctagtttcttgatgatggctaagatagtttccagtttttttcctcctacaaatgtataatgttgcaacatccttgtttgaacagtgtatatatctttgtatactctacatactgatgattttattcataaggaaaattcctggcagtttcaactgtgatagacattgctaacctgttctccaaagaggctgaaccaatttctgtttcctcaacagtgtatgactgtttcccccatctattctccagcactgaggattaagtaactttcatttttgtcagtctgacagatataaagcagaacatttctgcataaggttctacagtaatttttagattttatgaccctttggattatgcctacataatgatgatcaaatattcagaaactacattgtacctggccttaggcttggaattggatacaaaattaaatgaaaccagcttttgccctcaggttgatcccatctcctggagttggcagacaaatgaacaaataaaatgagagcaaaactgtatggttcacattgtgctagagaaatgcataagcttagctaacttttgtttgataaactctatattcattaatatcacaaatgaattcataaaataccgtatgcattatgtcccagggtgtgaggaggcttgaaattctcaaaagaaaacaacttgattagaagcaaaaagaaaaaaaaaaataatggagcttatccttagtgggggcagcagaagaagtgggaagttaggaaggggtgagtaattttagaatagtctctttggtagtttccatgttcacaaatagggtttgtttgagggagcctgtggggaaacccagctgagtttgcagctggcactgattaccgatcactcaaacccgggcagatctgtacgttggtccagatagagtgggagcaaggaaacaggaggctggctttaaaaatcagcaaccttgaagctcatagaggttggatgtaggtggcataaataggctgtttaccacagggattacaagcaggtgtgctctgaacaggcctgtggtagagtggatccatagaatggttttcaatcaatgaatgaacatcaaacatctgtctatgtattgtaaagggacctccttctcaaaaagaataggtccatgtagaaaggggtatgatcatctggtcgacccacctggggggaaccaagccttagctatatacattttctttgggcccacctgtcctagatagctcttcattcacttgagacatcttaaaagcaacacaacacaaggagcagttgagaaaatcaactgaatcagcgctgtggaatgaacctaaccattgttttacaacaaatcccctcagcagcgatatatagagccaattgcaaagcatgcagagtggaaaagggactgtgaagaccagcacaatcttagtccaccctcttacaggaggcaaagggcaggggccaggcgaggtatgtcctggttctggtcccagggcccaccctcctcctcccccattagccaagtctgttttgcccagtttgatgttacagctcttgttctaagtcaaaggaccactctctcatggcagaacagaaattcttcatgaattttcagtctcttggccagcctcctgtccaccctctcccacgtattgaatacctaccatgtgctgggtggcgctatcatgggatgtaaaggtgaacaatacatatcccttgtcttctgagagcatccagtccaatggaagaggcagatctgaaaccagcaattaccagagtgctgagtgccacagaagagatgtggtcaaatgccttgggactagagagtggaacgaagactgtttggcacaggagagataaagaacaattcagaggcaatattaagacattgaggctgggtgtggtggctcacagctataatcccagcactttgggaggccaagctgggcggatcaccttaggtcaggagttcaagaccggcctagccaacatggtgaaaccctgtctctactaaaaatacaaaaaaattagccaggcatggttgtgtgtgcctgtaatcccagttactcaggaggctgaggcaagagaatcacttgaacctgggagccggaagctgtagtgagcagagatcgcaccactgcactccagcctgggcaacaagattgaaactccatctcaaaaaaaaaaaaaaaaaaagacattgagacaatattgtctaaatgagacaaggcaagtgctgagcacggtgcctggaaagcccttaagagatgatagctattgtcattttagcacttgagctacctctcaaagaacaagaggagtttgccaggtggagagaaagaagggtactgccactcataaaacagcatgtgtgggtcgggcgtagtggttcatgcttgtaatcccagcactttgggaggccgaggcgggcggatcacgaggtcaggagatcgagaccatcctggctaacacggtgaaaccccgtctccactaaaaatacaaaaaattagccgggcgtggtggcgggcacctgtagtcccagctgctcgggaggctgaggcaggagaaaggcgtgaacccgggaggcggagcctgcagtgagctgagattgtgccactgcactccagcctgggcgacagagcgagactccgtctcaaaaacaaaacaaaacaaaaacagcgtgtgtgaaagtgaggaggttagtgtggtgtagtgaaaattgcatgggctttgtagcagatacatcttggttcaaatcttagccctgccacttcctagttgtgactttgggcgtgtcaagaggagcctccttttactaatatatccagtgggggtaatgatgcctgtttctaagactcattgcggggattaaagtcaatttatgcatagtacctggcacacagtagagtctcagcaaatggtgagtaccactggggaggagtgaatcatcagtcctgttcggtgcagctggaaaattgggtatttagtgagttgggggaggggagggaagtcaggctggccagagagaaagctaaaatgtcaaggcccagatattggacggtttaggctgagagcttgaaactggacagcataggcagtgggagccatcagatgcttccctccaagggaaatacaggatcaaacttggtttaagagtgaaaactccaccagcgttgtggatggctggttggaaggtaagcggtggaggcaaggaaaccactttgggaactgctgcattcaatattcttgtcttgacaacagctcagattagcatagcaaaggctcagttaactcctgcagtcaagtgctgtctgggcaggcagttatgggcagtggtcgagtgtgtaggcttcactgattgtcctcttttttttttttttttttccccttgagacaagatctcactctgttgcccaggctagagtgcagtgatctgtgatcgtgcagtggtgcaatgacagttcactgcagcctcaacctcctgggcttaggcgatcctcccacctcagcctcctgagttgctgggactgcaggtgggagacaccacacccagctaattttttaatgttttgagatgaagtctcactgtgttgtccaggctactctcaaactcctgggctcaagccatccttccatcttggcctcccaaagtgctgggattcaggcatgaaccactgtacctgaccccttgtaattcttgcaagaaaaaggaaaaaaaataaaaaagagcatgggcttcagtgtcaaagccaatctggatttgaatcccacccctattgcttactggacattgggcaattacttaaccctatggagcttagtttgcccttctataaaatagggattaatagtacttttctcataggcttgctgtgaagattacatgaaatagtatgagtagctaaaacacatagcttagctctaggaatgcagtgagtgttcagtaaaagttgataattgtgataaaatatattactagctgggcatggtggtagctataatcctggctgcttagggaggctgaggcgggaggattgtttgaacccaggagtttgagaccagcctagggagcatactgagaccctatctcaaaaaagataaactaaaaaataaatatattatgtatatgactatagaagacttttttcatgtaactcctattaacatcctctggcgctactagtgttctaccaaaaacatcctgctttcagacttcctggagaagcagcagcactttctgctccaagaaatagtaaggagagttgccaggttctgacacagtggttcttgggtgcacatgagacccacctggggagcttttaaaaacgtcaatttctggctgcgttccagaccaattaaactagaatctgtcgaggtgggacccagagagcagtatttaaaaaaaaaaattgtgatgatttcttaaggaaaaacaaatacacaaaagtacacaaatcttaagtggatcaatttttcacaaactgaacctatctatttaacccatatcctgcttggagtgctaccagcactccagaagccccctctccaaccccgtatgtccctttccagtcactccctacaccctgaaaccacatagattagttttgcctgttgttgaattttacataaatgcaatcatatagtatgcatttttgtgtgtttgggttattttggttaacactgtttgcgagagtcatccatattgttgagtgtaattgtatattgttcattctcattgctgtacaatgtttcattgtgtgaacaaaccatattttttctccaaactacttctgggggcattttgggttgtttatactttgcgtctattagaaatagtgcaattaacattcttgtgaatgccttttagcgaatgtatacagaaattgctggccgggcgcagtggctcatgcctgtaatcccagcactttgggaggccgaggcgagcggatcacctcaggtcaggagttcgagaccagcctgaccaacatggagaaaccccttctctactaaaaatacaaaattagccgggtgtggtggcacatgcctgtaatcccagctactcaggaggctgaggcaggagaattgcttgaacccggcaggtggaggttgcagtgagccgagactgtgccattgcactccagcctgggcaacaagaacgaaacttcgtctcaaaaaaaaaaaacaaatttctgttgggtgtattcctaggaattcaattgcaggattataggacatgcccgtgtttaattttataagacattgctgaacagttttaaaaagtggttgtaccaatttatattcccactcagtgtgtaagaatttttgccaacagttggcattttctgtcttaaaaaaaaatttgagccaggtgcggtggctcacgcctgtaatcccagcattttgggaggccgaggtgggcggatcatgaggtcaggagatcgagaccatcctggctaacacagtgaaaccctgtctctactaaaaatatatatatatataaaaattagctaggcatggtggcaggcgcctgtagtcccagctactcaggaggctgaggcaggagaatggcatgaacccaggaggcggagcttgcagtgagctgagatcgcaccactgtactccagcctgggtgacagagcaagactccgtctcaaaaaaaaaaaaaaaaaaatttggccattctgatagatttgtagtggtctttctctgtgatcgtcctgtatattcccagcatctccaagtgattccaatgccaagtttgagaacgtctttcctaacagattttgcaaaagcagagtagaactggggaaagagatgttgtaatggtgagtgcctccccatggactccctgtgatgtcccagagtttttggtagaactgacctggctatcagccagtggagggagaatgttcacatgtgtcaaacctgacagcctgcctctcattcctatgtgctttatttggagcaaatggctccaccagaagtgatctggaagctaagggggaagcactatgaagctctggaaagatgccacagcaggactttcatctctttttataatttaagacctgaatgagaagggaagatatgagaagtgactagtgggctatatacacattgtcagagaagaagagctggtctttgtgacatatttttttgccccaaaggctgcctagaccctggcacttggaaggtgctaaaaaatggtcattgaaataaacatattagaactatccctagtgagagacaccacccaaagaggtgcagaggaaggtactggtgagaatttagtggaattgatgctttgggttcttttctttgtaatttctatgttgctgctgagatttcctatctgttcttttattacaagcataatttcctttacattcttgagcaaagttataactgctttaacaatctttattatttccaacacctgggtcaccttgagattggtctccattgattgccttttctcttgagtttgagtcacattttcctgtttgtttgtttttaatttgcctagtaattttggattacatcctaaatgttgtgaatgagacctgaagagactctgaattctattcctcagaaatatatatatattaatatatataatatatattatatttacattatatataatttataatataaatataatatatatatttttttaatcaggcaattaacttgaccaaactcaaactccaaactcagtctttcttgggtggacaacatctgaaatctttgctgaattcatttagctttagttgaactacttgaagtctgccttgtatgtacatcattcagtgagatttgggcactgtttatactcagaatttggggctactgttctgtgattcttttctgggatatttctccttattttccagctgtggttacctgaactctgtctttaaactcctcaaatagtaagagagtagttttctatccaagttttagctagtaagtacagcactgactgggcgcttcccgcaaataaaaagccattaaaaacacgaaagttatctagtgccatttctttccttcaggtgttgcctcctctccagtttctacttgcttgtagttgaacacatttagtgccttccaatcttttttttttttttttttttttctgtctagagttcgtaatagttttgtgtgggaagtttggtccagaaagagctactttgcccttactagaagcaggacctctctgatcaatagctttgttcatttagggatccttagacccaccctactttattgcctacctcatatagatggcaataaatatttgtttattggctaaataaataggatttaaattaaaaatggaagtgaattttcagagaaaattgccagaagaaaaccctgaaactagtagttacttattgttggcatcaagtatgaaacagagtgttcaggaatttgctgagtagaaggatgggtgtggtagtagagctccagacatttgagtgtagaccaaagcagttaacaaagtgaacctgagattttcacatgaggagataaattcaattgtgttagcaataccactttcgtggggtgaaactatggcttatagagaagttatcatgttcaaaggaaatacaaccggtgagagggaagcggaggtatgcttggagttctgtatacccaagaggagggaatcaaagtggaggaactttggctggagatcaaagaggggaggaacagaagtaatgctctaaaggcagaatactacagcctgcttctctgcatggtgacctggaaggtcatagatccagtactgagacttcaaaacctgcctatgggatggaaacttcacttaccaaaatgtagggcatctggaaactttctgatttattgtactaacagtttcatctctcagacaggagaggagagaggccagttgctgttgtgaatctggtttgggagttaccggatgaagtgaaagtgctcactgaggccaggcacggtggctcacacctgtaatcccagcactttgggaggccaaggctggcggatcacttgaggtcaggagttcgagaccagcctggccaacatggtgaaaccttgtctctgctaaaaatacaaaaattagctgggcagagtggcacttgcctgtagtcccagccactcaggtggctgaggcaggagaattgcttgaacctgggaggttgaggttgcagtgagccgagatagtgccactgcactccagcctgggcaacagagactttgtctcaaaaaaaaaaaagaacaaaacaaatccaaaaaacacacaaaaatgctcactgaaaaaaggagcacccatagggggttgagcctataggggtttggaaagcagattttatgaaatttaggatgagatatatttcctgcccaaggctccaaaagtgatgacagctccaacagtaagggaagttatgactttaatcagatatccttactctgcatagatttcatttattttccttcaaggactcctcttaccgtcatgcctccgtggctcatctttcctgtctgacatttttttttttatttttaaggagaggggatattaaaaatacttaactaatggcatagagactgaccaatcaaaacagatgccagactaatcagaagagatgctaaccacacacaactggaacatcagccctagttacgagttccctaacctctccgagtcccagttttctcctctctgaaatgggaacaatatctacattgcagagttggtgcagtgattcccagaaaggttacatgcaaagaacttggcaggtggaaggtatgctggacacagaagctgccatgattacctggcattctttgtttctaggttcatttcatgtatctagtttataggttctgcaatgttagcctttagtttcattaagcatgttttactctatactgacttcagcaagtatttgttctattaccagttggtctctctggttttttggccaaaatgtccccatctccctggtcacgaatactgtggattttctgaaatcttcttgaaattcatgagaaagatctgttaaagatggttatggttcctttagagattttcccagttccttcttctccttctgctttttatgggtgtagcctttggagttaggcagacctgggttcaaatgtcagttccatcccacactggctatgcacttaattggaatctgctctctgcgttgccctctgtcttcctcttctcattcttttgtcccccagggtaggactttttccttcaagttcaattctatgcttttaatcgtccttgtttccttggaattattctctgagcttcagtgaacaaactatatgaaaagtttttaaaaattcccatcccaggctgggcatggcggccacgcctgtaatcccagcactttgtgaggcaaagatggatggaatcactggaaatcaggagttcaagaccagcctggccaacatggtgaaaccctgtctctgctacaaatacaaaaattagctgggaggctgaagcaggagaatcacttgaacccaggaggcagaggttgcagtgagccaagatcatactaacacactccagcctgggcaacagagtgggactctgtatccaaaaaaaattctataccaactacttcctaactggctaagaatatccctggctaaaggggaggagatagcttgttagggatatttgaggtttctgaaatggagagagtggtcttataaggcagcaaattgtgttccccttcctcttatgctggtaatggtgtggagcccaagatgcttcaaatggacaagacagtgatccccagacctggatgaggaagggtgtcagtggcgacagtgccttggtccttttccattcctgaatggaccctatccaattaccaacagcatgctgtctccccacattccagggccagccttgggagggggaagtaggaactagaaaaaaactgtaaaagagccgcaagtgctttagaagatcttcctggtaaaatgcaagaagatatcagaaaatccattgtattagtgatcagggagataaggggacattttggttaacaaaccagatagaccaatttgtaatagaacaagtacttgctaacgtccatatggagtaaaatagggactgccctcctctgcttgagttcctagagtctggatctagtcaccttatcagggtggagtacagttcttcctttgctccctaggatgggttattggaaacattcctatgtgaacctgagatttccttgatgcttatctaccatggatgccacagtgagttgttgctgttgtttggatgatattctgggatttgaagggcctttccactcatacctgataacttcctagatccttggcctcccaaagtgctgggattacaggcataaagtaccatgcccagccaaggattttaatcagtggatacaaaggcaactactggatgatgtagaacagaattgcgtactcagtgtgcatgcagccacttcccacctcttcagccatggcaggctttgctaattgatcacaacacacgttctccctgttatcacacatggcttcgtaatccctctcctcacagtgcaccaagtagccaccaccaacctaagtggtggcacaagagaggaaagtttggtcatgagtgttgtgctgggagagaaaggcagggattagaggccacccccagcctacccgatgtgaagggccatccccaatttaataactgtgtaacccaggagtgtgttcggtagccacaggtggcctcctttggaaaatgatccctccagctgcaaagggagtttttatctccctgtgaagggagggggtggaccacactccctcaagcctggagaaactgtttgtaatttgactcccgtttccccaagcttagctattacataagcttctttagaagacaggctgtttggtttagcaccgtgactgtgactgactaatgcgtttgtagacatcatgttagctttgtgtgtgcccctgtccttggcacccttgttcctgtcccctacggccttctccacactgctgtacttacccaaaagtgtgtgggcttccctgggttcaagttcttgcaggggaagctcagcatggaagaccagtgtgttcatgggtattcctttacctgtttgagctgtggcctcctttgaagttttcttggagctgagcctgagagagcggcttcaccctgacaggcagaaccaatccaaatcatcaatcagcacctgcttaaaatgggccttgcaagttgtgtagcctggtggttaccaaatgctgggtgcagatatgcatgatagagtgcttagtcccaatacgatgccagcccctgcaggccaggattggggctcatgggccttcatggggccattcccgtctaccacccaccatagacctctaaaggccatggagttcctggtagtggggactccagcatcatgccatggctggactttgttgaattatcactgttagacagtttatcctcatgccaggctgatcctagttgttctttttaaaaaattattcatgtatttattttttaaatgatttatttttattttttagagacagggtcttgtcctgtcactcaggctggaatggagtggtgtcatcatagctcactgcagcctcaaacccctgggctcaagtgatcctcccacctcagcctcccaagtagctgggactagaggcacacgccaccacacctggctaattttaatttatttttgtagagacggggtcttgctatgttgcccaggctgtggatcccactcttcatattaccatgcctaagcctcactctgccctccagaggcctggaacaaagccgatccttttttgttgccttttgttaacacctggtctgctcccaatatggcccagccagttcagacagaggtcagtaggtctgttattgttccactgctggacatgatgacatgattcttctcctgggaaagctcaagatgcatgagttgtttcatcactctttgttcttgttaaatgtgtggtttttgaatcctgcctcctctaccttcagcctccccaacacacacaaagtcctgctaaatggggttatagtcaatgggcttcaggggacagtgacaagtcagagatctgaatgaaggagcacagctgggagaattggagttacggagttgacctgtggggatctgagtttcacgactgatttaaaaccaggagatctgtctatgatggcaatgcccaaagtctagaaggttcatcctagcaggagtaggacagtcagtccacaaaaatcccatgggaatgagattaggggagacaacattgatttctaattcaggtatttggagcaccaagggccccagaagtctctttgctcatgagttaaagcatctttatgctggaaaaaaaaaatgacgctattattcaaagaagtgtgttgtgggagggcgggggtgtacatcctttaggagagaaagtaggtcccgagtgagatcccaggagtaggaaagccagcactgtttgttttgttttcttctttccctcatgctcaatggtacaggaaacacaaggagaaaaggacccatcgccttcctccaggctgctgccaatattgtgtagagaagaatagctgaagaacatgaaaacaaatcttcacatttccttttaacagtgtgaactttgaaacactttctgactcatattttaaaatctcttaaatttgaattcaccttccttcatgttgtttttctcgaggcactaggcttgagtccaaaaatgtgtcaaccgactgctcccccagaattaagcagtcacaaagcctgggcccgcttctcccagctgagtgggcagggaaacctggctttgaccttcctacccttcctcaaagctgggcctcacctcaggcctgaagagccaagaaataaccattgtaaggggaagaggaggtatttggtaatatgcctcagcaagaggccattcattttgctacaagcagcagttgcctctggggtccctatttctgcacccctaaaaacatcattgctgtctcttaaggtgcttttggccacaggtggcaacatccaattcaactggctcaaataataaaggggcttttgttggcttggataactgaagtcctgagaccccttacttaaaggaccctgtttccctctggtgaccgccaagcattggtttcatccaaaagccagcttcctgcagggatggtggcaacaaggcttccaggagcaactgtgtgttgtgcttccagttcacagattgtgagaagagagagcttctgattgggccaactcaggacacgtgcctagcctcaaccactcactgtgctgggctcaggccgctgctgacaggctctggcccatcaggacccagcactgagtaataatgtgggaatacacagatcaccaccaaaccagtgcctctgtagttttcccagaggtatatttattcccccaaataacactcttgtaatagtcttctttcttttttgaaggtggagagtgtgaggagttctgtagtacatcctgcctactcccctgccatattttgggcgatgctattattcaaagaagtgtgttgtgggaaggcgggggtgtaccctgccatactttcttgcctttcccttaaagggtcagccctctggagctgagtctctgcttccccagatatgcactgactctgtctctccctttggggtcaacaagaggaatggagttcggactttgtcagacaagaggggctgagttaaggctctaggggaagaggtgaacacacctcagtggcctgttcctgcttccccaagggtcaagtgccttggcctcagacttcctgctggccacagtcaaactattttggttcatccacccagatgttagaaaaattaagtaccctaccctatttccccttgcttctgatttctcttctcatatcacagatacttcctggatgacctcacccgacctggcctccacagatccctgccacagatatcttgccagttctggacactctgttgacttgtgggcccatgtatcccattctctgcaggatgttccgtctggattttccgatgctgggcttgctatgtctccatggagctggttttcctccaaatgaggtcttccttggggatcccctttaagtcttgatgataaccattgctctcccaggtcctggcagtttgtgctgtgttcccatcaccctctggggctttctctggaagtgtggataggtgagcccaggtcttacaaggaggacagtctgcagcctattggagccatggctgccgtgggctgccccagcacccaggccagtgccctgtcttggggccaccccgctgctgtgtttgcagcaccatggcagttctttaattagaccaagcagggatttctcagacgggggtgggaggaggtgtgcgggtctattgggggaaactaggtcacctgaaaaccagtaatcaagagggagctgtcctcgagccccagctccaaggaacccagaggggcaaggtgggaggggctcgcggggagggccaagtcagagaaaatatgcctctggccccttttactggcccttgggagacattgttctcacctttctccagggagctgggcaactgcccttaattcctttgctgggagtagggaggacactgcagtggtgccttctgtctgcctggggcctgccaccctggggcccatggagggagcactgtgctgtgagtcaggccccaggtttagttactgctcagcctctgtatccttggagcaggtcacccactcccatgtgtctgtgccatccatccactgcacagggactgtgtctgcctttaccctgctgcctctctagccctgagcacaggcctggcatgtggtagatgccacctaaatatttgtcaaacaaaataatgagtttatatgagtgcttctcttgtaagattattgccacgaagatcaatggcaagatgggtttcccaaatatcagtcacttataagttttgccaacactaaacgccattgtcattaaatttttctttactatcaacttcctatttccaactgaaatagatttgtttaaaaaggaaattttatatcacaaccataaacaaacagtaactgtgaaaacaaatccacaggaaacaaaacaatgttattacattctatcctagatacagtggcttgcccaggccaggagctgaggcctgctttctctttgttttgaaggaggattggcatagttataaagatgttaagggtctgttagcattggactgacacttttctctggagaaagtctgaaagattaaaagagaagtgaaaagcctatataccctgctctctgtgtgggtccatgttacgtcaaggcttgttcctgtacttttgaaaatttccttggaatggattctccttccacacttagggaagcacttggctgagatgatggctggggaagttctttgaaagggataaagtgctgtaacagcgcaagtgattggtaccattactctttacttttagcatgtttttggtaccttccactcagaggtgatcagtcataataatgaagaaatgagtaactgtgttcaggatcttagggctgaaagacatctcacagaatacttaggccaatctgacacgggtggacattttatcctccagtgagtgacgaggaacttgccacctcctgagacagccattgaccacgagcacctttgtcgaattgcttgttggacagctctagaggccggtgtctgttcttggggtgcacacagctgcttccttgtacttccttgttcctccaaatgaggtcttccttgggggtcccctttaagggttgatgataaccattgctctcccagatcctggcattgggctgtgttcccatcaccctctgggtctcacgaggaggccagtctgcagcccattggaacctggctgccgtgggctgccccagcacccaggccagtgccctgtcttggggccgcctagctgctgtgttcaccctgctgtgtgttggggagactcacaggctctctttcctttcttgttcagagtggagctctggttatttggaaactgctgtctcattctgcctaagacagagcttgcaaactcaaatgacattggagctggcaaatgatgtcagttagtgagggcagtcaggcgggagtaatggggagcattggggactatggtaatggagagcgtatgtgccctatctaaaggggacagcccgactctacaccagttgatggtgatgccgtgtgagcccactgtggccccataccaagatgttctaagaaaagcagaccccccgatgttggatataaaatctccaagttgtaaatgtcagcaatgaattaaaatattttaaaacatggtgtggacttcgaccaaactaaccaacaaacacgatgtggatcacaggaggctttctggtcaggcctggcccacagccacaagtggctcatcactgccaacaagacttctctgctccttttgggctgggcagccacgtcctcttcgggccatgcttgtgcatgttggtttccagagttccctccattgtggtcagccactctgtacacctttgagcgctgcctaactccctctcagctcgtgtctgctcctttcaactggtgaaatcctacttctgcactgagattcaaatctgttgtcctgtattctggaaagccttccttgagaaccccgggcagactggctcttccactatctagcggtggtatgttgggtaaatgacttaatcactctgtgccttagtttcctcatctggaaaatgggcatgatagtacctagtactactattttattaggttactgggataattaaatggatttatgagataaattgacagacagaaggcagaggtggtccgcatccgtctctgaatcagggctcgtcacagagcaggacttcattaaatgtttactcactcgaggaagtggagtgaaataaacttgtgatctgctagctcccagagaggtctgactataataatgatattgtgtggttgtgaattgaactcttttgaactccttacttctaaaaaagcaaccaaaacatctatatctaagtggctaaaatagaaagcagtgacaatcccaaatgctgaaggggaactggatcactcacacattgctggagggtatgaaaccagcacagccattctggagaacagttgggcagttttcttttaaaagtaaacatgtgccaggcgcgggggctcacgcctgtaatctgagcactttgggaggccgaggtgggcagattacctgaggtcagcagtttgagaccagcctggccaacatggtgaaaccccgtctctacaaaaatacaaaaattagccgggcatgatggtgggtgcctgtaatctcagctacttgggaggctgaggtgggagaatcgcttgaacccaggaggcggaggttgcagtgagccgagatcacgccattgcactccagcctgggcgacagagcgagatctcaaaaaaaaaaaaaaaaaagtaaatgtgcaattaccatatgccttatcacttgtactcttgggtatttgctcctgagaaacaaaaacttatgtttacacaatctgtagatgaatggaacagccttaaactggaaacgatgcagatgttcctcaataggtaaatggttaaacaaattggggccatccataaaatggaatactacccagcaacaagaagaaacgcactattgatgcatgcagcaatgtggatgaatctcaaaggaatgatgctgggtgaaaaaagccaatcctcaaaggttacctgctatctgattctatttatataacatcttttgaaatgacaaaattctagagatggggaacagattagtaattgccaaggcagggacaggagtgggttggagggggagcctagagaaggagataggtgtggttatgaactgaggtggtagatacattgatacaattgcataaaacaaaacacatccaaataagtacatgtgaaactagggaaatcggcataagattggtgggttgtatcacgtcaggtttctggctgtgatactgtatagtagttttcaagatgctaccactgggataaactgggtgaagtgtacacagaatctctctgtactatttgttacgctccctgtgaatctacaatgatctaaaataaaaagtttaattagttgaaagtgcattgcaagtgtattcaaaacagaaatcaaaacaaaacaaacaaaaggcaaccaaaaccagctagcttgtctcccattgagccttgccattggcttatttatgctggaggtcacacccactcagaccctggaacttttgccctttgggcattgccaagccaaccccttccccattctgcctgcttactctccagtctccgagctgggagagacatgaagaacgatctggatctgacccaatctgagcacctgaggatttagcctgagccctgctcttcagcttctgtagaaagggcttttggaggggcgggtgacgcaggcgacccaggagattaacaacgcttcctgaaaccaaccaggggctaacccaatactctttgagacagtggaccacatcacacagatgtagactcctgccattctttcctgttacccaacaaccataaaccagccttgcctgctggttcacaaacatgctgcatttacatctccctaccattcctcctccaagcttgtgtctcattgtttagtgtcttaatgtttagggccagctcttttttaaaaaattattttatttttttgtagagataagggtctcgctatgttccccaggctggtctggaactcctggcctcaagctgtcgtcccaccctggactcccaaaatgttgagattgcaggcattgagccagtgcatccagccccagctctttttattccttgcacctgtaacttctgggaggtggataggacactttgcaggtggaggaacaggcttagagaggatcaagtgattgtcctaagaccctttccctctgtgtctgaaagttcatagagtccgtgctgaagaccagctggctttagactttgaaattttgttgacctcatgttatttgaaactcatgagagcaaggatgtaatttttttttaaaggtcatccaaagagagaaactttaactaagattttctatgtcccagtagttcagcagtttttaaacttttttgtcttaggatttctttagttccttaaattgagcatcccaaagagcttttgtttatgtggattatatctgtcaatatttatcataatataaatgaatattgaggaatttttaagaatagcattaattcctttaagataaaaccataaacccatgatatattataacaatataataatctataacatatttttattagactgttataaaagcataacatataatatataacattttgatgaaaaatagctatttttcaaaacaaaaaaaatttagtgagaaaagtgatgtttaaaaattttgcaaaattctttatgttgagcttagcagctggattcttgtatctacttctgcatttagtttgttgcaatgtcacttttcatatagctttgggaaccactgtatactcataagataatgagtagaaaaggttagtaatatcttagtatagttatgaaaatagttttgacctatggacttcttgaaatggtttcaggaattccctatggggttcccagaccacactttgagaagcactgcaatagtgtattgtttcttctggtctctttcttgtcctgtctgtcccatctccagtacaacttgcatcccatagtgatcagaacaaaagaggcttgagcagaagtgtcagatgttcataattctgaggccttggatgtttgtatagtctccagatttttgggggcctgcagcccccatcatgtcctgaccctccctgcaccccttctgattccagcactcagatacccaaatccttaaagtagggtgactctatacaagaaaactaaaatggcatggttcttgttaaatagctgtggctagagaggcagacaaccaagctatccaatagagctttctgcagtgatggatatattctttatctgcattgtccagtatgaagcatgtggcgattgtgcacttgaaatgtggatagtgcaaccaaggaattaaattattttactttattctaattgatttaaatttaaatagccacaggtggctactggctgctgcattaggcagcatagccagaccttgctgatacttacagggccactgtaaggatttgcacttctcttgaggagcaatggaaggaaaacctcaaaagcgtttcgaacacggggcgttgggggacgatcagatctgagttgtggagtctgacacatgtgttcatctgtgtctccctccctgccacaggccacaccatgaggccccagccccaccagaggccccgcgctgccctggcccccggtgcaccgtgctagcccccagccagggcgttggggagggcggtggccatggccagtcacgtggacctgctgacggagctgcagctgctggagaaggtgcccacgctggagcggctgcgggctgcccagaagcgccgggcccagcagctgaagaaatgggcacagtacgagcaggacttgcagcaccgcaagcgaaagcatgagcggaagcgcagcacgggcggccgccgcaagaaagtgtccttcgaggccagcgtggccctgctggaggcctcgctgaggaacgacgccgaggaaggtaggcccctctgtgccttggcggccacgcagctgccttggcctctgatcagggtttggaatccaggttctgtgcagtagacgtgtgggcaaggcaggtctgcagacccacttccaagttccagcagccccattcctcttaggaagtggacgttcctaggaacttcgaatttatcttagacttcttttttttctaagacagggtctcgctctgtctcccaggctggagtatagtggcgcgatctcagctcgctgcaacctctgccacccaggctcaagtgatccttccacctcagcttccctagtagctgggatcacaggtgtactgccaccatacccagctaattaaaacaaaaaaaatttgtagagatgggggtctcattctgttgccctggctggtctcgaattcctgagctcaagtgatctgcccgccattggtctcccaaaatgctgggattacaggcaagagccgcagcgccaggcctagactttttgtttaaacatcttcgttcatttgtttttatttatttatttatttagacatagggtcttactgtgttgcccaggctggtctcaaactcccagcttaaagggatcctcgtgcctcagcctcccaagtagctagtattataggcaggccaccttgcccagctgtatttttttgggaacaaggattccagcctttggctgaggaataccataataactttctttccctcccacaaatatttacagacaaccacaaatacttacagacaccttcttttgcattactttcctagatatagtggtgaacaagttggatctggtttctccccaccaaaagctcaatactcacaggatcttgcaattcataaagctctcctctgtgccagaccccatgcctggcaccctctgaatgctgttccgtgtattccgtgtatgtagcctttgctgcagtcataaatggtgtagagggatggactctgaagtgagactacctgaatctaaaactggctttctcagttccctacgtgagcttgacaagtagacaagtctcttccactctctatacttcgtttacacctctgtaaaatggggctaataagaaaatccactttaagggcttgctgtgaacattaagttagaaaatccctgtgaagttcctaaatatggtcccttatgctgaggaagtgattattactgttttattttattatattagtatattttatttacattatcaaaggatgtccataaagtctgaaaacagatatagacaatgctatctaggatattttcactctgtaaagtgaatgagtaaataaatataaacaaacatgtatacacattcatacaatctatgtttccagatttttttcttttttttttttctttttttttttgagacagagtctcactctgttgcccaggctgggcagagtgcagcggtgtaatctcggctcactgcaacctctgcctcccaggttccagcaattcttctgccttagcctcccgagtagctgggattacaggcgttcacctccatgccctggctatttttttaaatttttagtagggatgggatttcgccatgttggccaacctggtcttgaactcttgacctcaggtgatccacctgccttggcctcccaaaatgctgggattacaggcatgagtcactgtgcctggcctatgtttccagattttatggataccttgtacttgccatgtttaatttaattatattatttttgtgtctcatgagctagatatcatgatctgtactatgtatagtgctttaagagccatgtatgataacacccattttacagatgggggaattgaaactcagagaggttcagaaccttgaccaaggtggcagagcgggatcagaaccactggcatccgactcttgtcactgccctcatggccttataggtttgcttcctgttgtaggaatgaatggagaatccatgatgtaaccacagcccccttccctgggcttgttcagaggcggtctcgcctgctcattgtgagccaaggtctgtgcacctccctgttccccttggcgcccatggcccatccctgtataataagccttcctggctgtccctggagaggcctagccatgcttcctgggtccctgcacacaccttccagtcaatgaaagagcagagaggtgtggcacttctggcccaagagggtgctgggttttagtcaccttgctcttcaggttctagaaccctctgagaagtgtaattccacttccacctggctgcacagggctctaggaaacgagccaagaggcatccctggaaccactctgctgggagctgctccgctgaaagcctggggtgagcagcctgggtgaaaagagaggtggaatcttgggcttggggacatggccccgaggctccttcccacgtgcagtttgccaagtgatgcggcagccccatccccacgcagtgggtggcttgtcatgatgtctaatttttgttgggggcggaagttcatcagctcttctctcacccctcgttattgactgccttcttccctgacaaagccccattgcccctccctgaggggctctgtgcatgggctgcgggcttcagaccatcctcccagccccctgcccagcccctaccccttgctgatgtcttgtttcctggttagaaggagcactgggctgggagtggagggatcagtgccccgcagccctgcctgtgactttgagcagcttgtttcacctctatgggtccagtttttttgttttgctttgttttgtttttgagacgaagtctcgctctgtcgcccaggctggagtgcagtggcacaatcttggctcacggcaaactctgcctcccgggttcaagcgattctcctgcctcagcctctcaagtagctgagactacaggcatgcaccaccatacccagctaatttttgtatttttagtagagttggggtttcaccatgttggccaggctggtctcaaactcctgacctcaaagtgatccgcccaccttggcctccaaaagtgctgggattacaggtgtgagccaccgcgttcagttttttaatctgtaaaatcaggttttgaaagcttgccctcaagagggtatggcaagacttagacaaggtcctggatgtgacagttctttgaaaggttaccctgagacctgtaccagcacggtgataacgcactttattttgttttgttttttacagactttaatgtttttcagaacctaaatatgcacagatacattcttcttgtaaaaatcaatcaacgtagaagtgtacaaagtaaaaagtcctttctgtccctcccttcctccctctctccttcctcccctcctttgcttctttttgtccatccatcactactgttgttagtttgatgtttcttttccaggtatttttttcatttgcatatgcacttgtggacttaagagaaatatagagccaggtttcttttttaaaaagtttttacataagtgatggtatcctggatacattattctgcaattttctttttttttttcccatccaacggtatatcttggagacgttttcatgccagaacatgtacagtacagatctgtgccattatttttatctgctgtgtagtattccatagtatggattaccagaattttctaactagctccttattgatgcagatttttccagtagcttcgcttttgccacagtgaatgttttatttccatgtgcaaatgtttatcgaggacagatgtgatgaaatgaaagagatggatctgaaggtattaaatttgaatgagaaaagtgctagaccccatgggctggtccccctgtctctatggggcagccaagtgaggggaaggggccagaatactgtgctctgtggcaggctcgtgggttggttttagggtccacagttgcctgggtttggatgaggggtgtgaggctgccatcagtcagcccttgacctcactgggctatgctcagcttcctggcagcactacagagcctgctgctttcagcaggctgggaacggctgcttcttgctggtggagctggtgtttgggaggctgccggggtgttagctcacagtggcgtgggagcgtggggtggcagctcccccactcccctgagctcacagcagcctctgagtcaacctcccccacctgcctggggaatgtgagttgtttccagagaaaggcaggctaggaactcactgagtttcatcctctggtcccatattgcctttagactagtgtccttgcccttggacctgcctgagccccatgctcactgctctcactgccatcaccctctgccccaggcgacgccagctccaccaagatcctcccatattccctgcgttatcttacctccacacctttgtatatgcaattccctctgtctgggacactcttcctgtgactaactcctgtaaccctcagctttgagtccagcgtgatctctggggagccatctgtgagccttttcccggccctggttaaagtagcaactcaatacgtagctgatgtttactgagagacagtgtagtgtcatggctaggagcacagaccctgcagtttgtcctccaggattcaaatcctagctctaccgtttactagctgtgcatccttgggaaagttactttacttctcagtgcctccatctccccatcggtaaaaatgaggatgatgatgtacccgcttcataacgttgttggggggttaaattaagttgataaatgttgaagtggtatggtcagagctacgtaagtggtataaattgttgttattctacactattctacatttacgtaatctattattacagcatattctgattgtcatcattgttattatttatcaggtgctttgtaccaggcagcttgccttacatatgttatctcggttaatcttcacagcaactctctgaggttagagagtcaaaccccatttttaaaaaatagcttggggttcagtttacatattataaaatttgcccactttaagtgtactattcaatgattttcagtaaatttacagaattgtgcatccatcagccacaatccagttgtaaaacattgccatcgctgagtggtgtggctaacacttgttatcccagcactttgggaggccaaggtagaggatcgcttaagcccaggagttctagaccagcctggagagcctgtctgtactgaaaaaaaaaaaaaaaaaaaaaaaaaaaagccagccgtggtggcacttgcctgtggtcccagctacttggaaggcttaggcaggaggatcgcttgaatccgggaggttaaatctgcagtgagccatgattgaaccactgcactctagcctgggtgacagagcaagaccccatctcaaaaacaaacagaaagccttttcatcatcccaaaaagaagcctcatgcccatttgcagtgactcctggttcccagacccaggcaactataatctactttctgtctgtatagatttgccttttctggacatattatttacatggaatcatacagtatatgatctttgtgattggcttctttcattcagaatactgctttcaaggttcatccttggtgtgacatcatatatcagggcttcattccttttcattgccctgtagtattccattgtatagatattccgcattttgtttatccattcaccagtaggtgaacgtttggattatttctattttggggtaggatgaagaatgctggaaggcaaatttgggtacaagtctttgtgtggatatatgttttcatttctcttgggtcattacctaggaatagaattgttgggtcatatggtaaattatgtttaactttttaagaaactgctgtactgtcttggaaaatggcttcactgtgtgaattctcatcccccattttacagatgagaaatttgaagctcagagagactaagtcacctgccaaggtctcacaggttttaagtgtcagactcaatcccaggattcaaacccagatcagtttctccgaagcccatgtatttaaccaccaggcagtcctgtacttcctgcttttgttttcactagaaaactagagaaccctcagttgctgtactgatctgtgtttgttttggccttaggcatcctggtgtttctgctggcatcttgggccctttgatttggggcccccaagataaactctttagccccagatataacttctttctagggccacaatagcccagcctcccttgaaaccattgaatgtatgttaagttgttagagacttctgtttttctctcagaatgtgtagggttttctttatggaaattctcattcaaaaaatgtttgagtgattcttctgtactctaaatttaactcttattaaatttaatgatttttctcactgtaaaagttttcaaactcttttttaagcagtggaaacttttctttaaatgagatattatgcagaaacccaatatgtaaaacaaaggaaggagctgttctgactggggtcaggtgggtggggtgctcagtcatccctgccacctgcaaccccctcccccacccccaggcacagtgctggacacctgggccttgccaccaccatcttaaaccagcagctcatctacaggaactagctcagactttcacttttggtccttttaaaaagggaagtttcttttcttctaattattaaaaaaaaaaaaaccctgttattgttacagaaacttttagaagtacagaaaaaaagaagcattaagaagaagataaaatcacccatattccccctgaacagcaacaaccattgataatattttggtattgttgtgtcaggcagcgtcctgggaggaaacaaatggtgattttatatggggtgatttgtggaaagtttgataaaggggcagtttgtaaagggtttagggaagtggtcctcaaactttttggtctcagaggccctttatattcttaaaacctgagaactcctaaaagctttggtttagctgggttctatctacccatatttactgtattcgaaatttaaacggaggcattaaatatttattcattcattaagtcagaatgataaacacattatctgttggctatctgcttctgcgtagcagatgaactcaaaatttagcagcttaaaacaataaacatatactgcctcacacaatttctgtggctcagggatccagagcagctcagctgggtggttctcgttcaggatatctcataaggttgcagtcacttcaggatttacctggggctggagaatccacttccaagatggctcactggcatggctcttggcaggaggcctcagttccctgccatgtggccctctctataggacagctcgagtgttctctcagcatggcaggtggcttttttcagagtgagtgatccaagagatagaggaatccgcaatgcctttatgaccttgtgttggaaatcatgtaccatcacttctaccatcttctattcatgagaaatgactcactaggtccagcccacactcaaggggtggggaattaagcttcatcttttgaagagagaatttgtggacatgttttaaaaccaccacatgttaacataaatatttttatgaaaaattatatttttcaaaacaaaaaaaaaagcaatgaggagagtagccttgttttatatttttgcaaatctttttaagatctggcttaatggaagacagttggagtatcttatctgcttctgccttcaatctgttgtgatatgttattttggttgaagtaaataaagaaaatcttatgtagttggaaaagggaggaaatattttaattgctttttcagatattgtggatattctttgatactacatctaaactcaacaagtagtagtttcttaaaggttagttgcagtgctgaatctgaagccatatcaatttacatcaaaatccattggtctgtctggcattttgaatggttcttttacccatgtgtacttttttttaatgtaatatattggatctgttagaaaatattggttcactgagttacacagatcttccaaatgttgacacattgctttatacaatataagaaaatgtatagtttcaataacaatcttgccatacaattattcaggtactgggaaactgtaagttcgtggtagctataaaagttttctaaaatttggatttttgcttaaaagttcaaattctatcattggtaacaaatgctgtcagttgtgagaagatccatttgccctttttaggaaaaaaaacactgcctgttaaatactcaagtctgaataaccattgtttgctagacatcctttaagtaaaactagtgctccatgagagaagagactagcttagcacacagcttaaaaaatggctcaagtaatgcagttggagacaatgattattctttttttgaacttcccattttgtcacatggaatattaaaaggacatgtactcaaggattaaggtttcataaaattaatacattttattgctttatcaaggacatttttaagggaaactggtattgatttttttcttttgattgcacatacaaaacaatgaagatggtgattgctagtacagcttggtgccactaagttaattctgttaaaacaacagtagttttacccaccattgcttttacaccatcagtgcaaatgtcaacacagtggaaaatgcaagtaatttcttagtgttactgtgaaaattattttgatgttttaataccctgaaagagtctagagaccactttgagaaccactggtttatgggggtcaacaaggaatgggacaataccctgggatagcaaaagttgggagatcttacccaccccaccccaccccctgggcctgaaggagacaaggaaatgaacctactggaacctaaggaaggcaccgtatggagagggctacctaaaggagcagtggctgccactccatgcccctgccattctggtgctttcggtgacaaacctaaccagaaagcagaatgcaaggaagcctttgatgtagtgcaagtcaactggcttcctcaggcacggagaggggaagatctagagggacagatggggcagagagtgagcccagctgtcttcagcccttcggatctacacacaaacaaggagtgagtttgtgtacatttaaaaaacaacttttagggccaaatgtggtggctcatgcctgtaatcctagagcattgggaggctgaggtgggaggatggcttgagctcaggagttcaagactgcaatgagctgtgatggtgccactatactccagcctaagtgacagaggaagactctgtccctaaaaaataaataaacaaataaataaaaatgtaaaagtaaaaacaactttaaccctaacattcacttgtgaattcagcaaaattagtcatctgctagagctgtggtatcagggagagcctgtctgaggaggtgatttgggctcagacctgaatgtggaggagtctggaggaaatgtacaaaggatgtgtgatgggaacagggttggcgtgtttgaagacaggagaaagatgggaggtggaagagtagggggaggaggtggttgagggagagcatactgaccgtagaagactagagtaggaactgtacatttgatttcgatgaaaagccactggtggttttgaaaggggaatcatgtgatgagatacagattttgaattcgggatggattttcctggttgctgagtgcagaattgactgtagcaatctattttcgcagggctgtgaggggagcagggaggctcatgagaagccctcacagtagcgtaggtgagagcctatggtggtcactgggcgatgcagaaatcaggaggtggagcccacagggcttctgtgtcaagtgacagaggagggactcagtgatggcttttgggtttttggcttgaacatctaggtggatgacagtgccacattttgagactgggaagatcggagtaggagggaggaggggatttggagagaattgagttctataggactgtccaagttgacatgtccttttaacatccacatggagatcttgaagaggcagatgaatatgtgagtctggagctcaggggagatatcagggatggttataatacttgggaagtcatcagcatgatacaagtgcagtattttcaaaaatgcaggactgtaggaggtcatctaggaagcaagggtagttggagcagagaagggatcgcagagaagggatcactagagaaagctctgggacacctcaatagctgcatgttgacccaagaagaagagaacaaaggagaccagaatcatctactcagaaggtagaaagaaaaccaggaatagtgtggcatctcagaagcctggaagaaaggactgtcagctcagtcaaatgctgttgaggggttgaatattttgtcttatctttatatactctttggaaaaagagatttctaatgatgacctcatatatcctatcatggatgttccataatttatgcagctactcccttattattgcattttgaggccattcccaatttttgctactataaattatgccgtggtgaatatcaatgtataaaagtatttggttggccgggcgctgtggctcatgcctgtaaatcctagcactttgagaggccaaggcgggaagatcacttgagcccaggagtccaagaccagcctaggcaacatagtgagaccccatatctacacgaaatttaaaaaattatccaggtgtggtgacgtgtacctgtggtcttagcaacttgcggggtggaggtgggaggaacttttgagcccaggaggtcaaggttgtaagctgtgattgtgccactgcactccagcccaggtaacagagtgagaccctgtctccaaaaaactaaataaataaaataaaaataaaaagtatttggccatagctttgattatttactaggtagattcctagatgttcattggctttgaggtctcgatataaaccactcatttgactaccagagaggttgtatcagctgtgtgtatccatccctgctatctccccacctcatcactacctgccacatcaatgctggatgatgacattgaaaacacacctttgctgatatatttgatatatggaaaatagtcctgttgtcttaatttgcataaaatcgagacagttaaggttgaatacctattcataagcttactggtcatctctctccttctttgagttgtctagtttgtttttttgttgttgttgttttgagacggagtctcactctgtccccaggctggagtgcagtggcacaatcttggctcactgcaacctccgcctcctggattcaagcaattctcctgtctcagcctcccgagtagctaagattacaggtacccaccaccacacccgggtaatttttgtatttttagtagagatggggtttcaccatgttggccaggctggtctcaaactcctgacctcaggtgatctgcctgcctcagcctcccaaagtgctgggattacatgcatgagccactgcacccggactatttgttcattttttttactagtgtgcttcttattggtttcaatgattgtgtacgtttatgtttgtgtgtgtgagaggagacagggagaaggtgagaaagggggagaatgacattggagggagagatgccaactctttgttgtcatgtatggttcatatattttctgcagtgcgtgtatgtgtttgctttaatgttttgtttatagtaattttttatgctttggagttcttattttttatattgtcaaacctaatgatacttgatttctttttttaaaatcattttattttttttatccctttaaagcagggaccagaaaactgtggcctgaagtccaaatcttcccactgtctgtttttgtaaataaagttttattggaacacagccatgcccattcatttacatattatctatggctgctttcacattacaatggcagagttgagttgtaacagcgaccatgtagcctgcaaaggttaaaatatttactttctggccctttatagaaatactttatgggctcttgcactaaaatgtttcctcatctagtgatgtatattaaacctatgttttcttctagggttttttggccttatttaaataaataggtagtatttctggacttcattttagtatagagtactaaatgaaaatctgtctatattttgtttccaaagcatcagcaattgtcccaacatcccttccttccctacaagtttgtgaggccacccttgtactctagagcctcatctgtaatgaagggtaactctccaacctgtctattctgttccagcaacctattttggtgccagttacatactgctttcatccttgtaggtttatattgtggcttaatatgtgataaaacaagtttttcctcagattactcttttttttcaaaatgttcctggttattttcagctgttcacataatatttaggactgtttggtcaagttttccctccaaacctcaaaaatagatttctccaaagctttgcagggacatggatggagctggaggccattgtccttagcaaactaacacaaggacagaaaaccaaatacagcatgttctcacttacaagtgggagctaaatgctgaaaacacatggacacatagaggggaacaacacacactgggtccctattggagggtggattgtgggaggagggaggagatcaggaaaaataactaatgggtactaggcttaatacctgggggatgaaataatctgtacagcaaactcccatgacacaagttgacctatgtaacacacctgcacttgtacccctgaacttaaaagtttttaaaaaattaaaataattaattaatttggaccaaagtgatatgtttatcatactgagtttttctaagcgggcaaatagcacatgtctctgttaagcatgtattctttcttgtcttttaggaaagctgtagggttttttgtttgtttgtttgtttttgttgttgttactgttttcgtataagtcctgtttaatgtcttaaaaggagggctttgggttttgtacattaatgttataccaagcgaatttactgaattcaccttagtcttggtttttcagtgagttatcttgggggtttctatttagaaaagaacattatttgcagatgataaggttgtctgatcattccagtgtttcagtaagcctggagatctgagtcctatccagattctatcctctctccccttctctccaggctaactacttccgttccttttcatattcttttatgacatgtggctttgagatttgtgaccatgctctactctgtctacgttcttcccaaagtctgatctggctcactctggagtgaatggaactgtcactttcctcgttctggttgcttttgcctgttagtatgacttaagtttccattagctttttgggtagctgctgttgactcatattgaatttataagaaaacaaaacccccaagtcagcttcccattaatgaagctacattttccccatcctgatttaaaaacaacaacaacaacaacaacaaaaaaaaaacaaaaaactgtttgttgaagcataatcatcagacagaaaagggtaaaactagttgtattttcatgtgctgagcatacccatgtaactaatcagcactcagatcatgaaacagaacattaccagcaccccaaaagtcttcctggacacacggttgatttttaacattgaggtcaagcgctgcatttatcttgttgagttttgagcccaattatctacctgttcagctagttttggattcttgaatgatacgttaggacttttgtgtcaccagtgacaaaaactcaagctaacaaggttaacaaaacagtgttcacgtagtggagagttcaaagatagcacagcttcaggcacttgtggatgcatgagactaccaagaaatgtctctgagaagacgactatcagcagcttgaaatatatatcctaaatccttttggcaacctcagtaagaataatttattttcccagaagtgtcccaggctcaacaagtcccagaatggaacctcattggctatgaggtcgattcctgagtcaattgtaatggctagataagggaagcaatgctatgattggtctggttggagccatatgcccactcctggagtctgcttctcccaaacacatggactgacacttggtattatgttgtacctacccactcccccaaaaatattgggatgatatttccagaaggagggagaatggatgcttgtcaggccataattaaatatattcacctcaaatgaaatattcaccggcagtttctactccatatcattcataattgcaataaggatttgccttctagaccagaattgtgcaatagaatttttttctgatgatggaaatgtgctgtccaatacaatagctgctaaattttttattgtatttagttagaaataatgtagtcaactgtggctaagctagaggctgctgacttagaaacacagtcataggccattatccaaatccctgataaaaatgttgaatagggcccagcgtggtgctcacgcctgttaatcgcagcactttgggaggccgaggtgggcagatcacctgaggtcaggagttcgagaccagcctggccaacatggtgaaaccctgtctctactaaaaaatacaaaaaataaccaggtgtggtggtgggcacctgtagtcccaggtactcgggaggctgaggcaaaagaattgcttgaacacgggaggtggaggttgcagtgagccgagatcatgccactgcactccagcctgggcaatagaacaagactccatctcaaaaaaaaaaaaaaaattgttgaataggtcatgggcagagatgctgcctggggccacacccccggagaccttttccagattaatgtatcaaagtcaactactgggaatagttgtgcaactgaaatgaacttaactacattgttatttgcagttggtatgtgggaacagtagcaggagtctcgacaattaaaaaacaattaaaaaaaaaaaaagctggctgggcatagtggctcacgcctgtaatcccagcactttgggaggccaaggtgggtggatcaccagaggtcaggagttcgagaccagcctggccaacatggtgaaacctagtctctactaaaaatacaaaaattagctgggcatggtggtgcatgcctgtaatcccagctactcaggaggctgaggcaggagaattgcttgaatacaggaggtggaggttgcagtgagttgagattgcaccattgcactccagcctgggtgacagagtgagactccatcttaaaaaaaaaaaaaccatctttcctacaaaacttagaagacgatttctctctgagggttaaattacaacaaaatgtgatggatcagagtagcaattcatgcacagacatttatggaacatagtctggacatcatcaggctggcattggttgttcagtggtgaacaaaacaaaatgggccagaccaccttggagctcagagtctagcaaagtcattgtgaagagagcatagtattaacatgcttaacaatggatggtgttattataaagaaggccttgctgggcatggtggctcatacctgtaatcccagcactttgggaggccaagacaggaggatcacttgagaccaagagtttgaaaccagtctgggcaacatattgagactgtatctctaccaaaaacaaaaacaaaaacaaaaacaaaagccaggcatggtggtgtgggcctgtagtcctagctgcttgggaggctgaggccggagaattgcttaagcccatgtgggcaaggctgcagtaagtcacaattgtgccactgcactccagcctgggtgacagagcaaggccctgtatctcgcggggacggcggggggggaaggccttgtcaagaacagatgccagaaaaagggggctaggagatcatttatgaacaattctatttaaatatcgttcaagggagaggacactgtgagcaacaactttggtgattaccatcccattgctaaggacaatctgattatggaaaaaggggacttcaacccatcttggtgatcttggcgtaatcattaaacatgatgattatgtacaaccttctgattataatttggcgtcccagccaggtctgcctacaagcacagaatgagttgaccgtgcttaactgaatttcagacatgcaaggcaattattctcctgtgatcctggcattgtgtttttatgcagcagcctcataaacttggatagtatgagactgctcttgggagaagaaactgctgttggtaggctggtcaaccatggtcgatcaccaaggtgataccatcctagggatcttggggatatttaaccaattggaactcccttggaacctcccccaaatcaaaccacaatgacactcaaccagcatttccccagggtgctaataaggaggtgtatgagaggcttgtcaggtgctcaatggagtctagacattttctatctttgacatttctcagtgtagtgaacccattgagaagatagatgaggcattgctagcatgattgattcttgcttggcttctagggaccactgtttcctttttttttttttttttttttgcggggggtgggggtagcatggggggataaagtcttgctctgttgcccaggctggagtgcagtggcatgatctcggctcactgcaacctccgcctcccaggttcaagtgattttcctgtctccgtctcctgagtagctgggattacaggtgccaaccaccacgcccagctaatttttgtagttttagtagagacggtttcaccatgttggccaggctggtctcaaactcctgacctcaggtgatccattcccctcggtctcccaaagtgctggaattacaggcatgacccattgcgcccggccccactgtttcctttctaatcgagtgagaaaatggtcagtatttctgtcaacaaaattcatgaggctctttgtacgcacagacttcaggcctttctctcaacaatcgccaaagctggagcatcacatggaggaacactggggtttgaaaaacaggaatgttccagaatcttctcagagtattacattttccaacatgtccatcccatatttgtaccaacaaacagagctggtcccactgccctcatcctttgtctaccatgttaggctgaggaagttgcatgcagagcagaggtgaagactaagagaagaagatacaagaaacctgctgagtaggggagagggaaatggtacctctgccagttatgctggaaaagctaaatgaaacccaaatcttgatggaggtgttagggttttcagtctttcaagagaagctcaggacacaggctttttggcttaaggaccccaaatttcctgggcaccacaaaagtagtaacggcagtcctccaggtgaatcagtgtcaagagctagactgtaatcacttgccttttgttgcattacaagccactcttgaaacacttagtggattgaaacaacaacttcttatttctcaatgattctttggcttgactgggcactctttctgctggtcttccctgggcagttcttctgctggttctgcctgggctcactcatgaggctacaggtagctgctgggtcagccagtgtctggggctcagctgggatgacctggcctctctctgcctgtggtcctttatccagcatgatggtctcagggttccaagcaagtaagccccaatgcacaagtatttatccagcctttgcctgcatcgcgcttgctcatgtctcattggctaaaacggatcacgtggccaagctcagagtcagtgtgggaagagtctatacaagcgcttgggtactgaaaggcatgattcattgggggccattgttataatctaccacacattctagactttgctttgctttagatccgaattctagcaactcgatgtgataaccctgggcacatcatgttgctcgaacactgtaattggctattgatgtccctggaatgtctgagatgtatggggtggaccaaacactgcctctctctgggaaccccggactttgggttgagaatgcctagtgtttaggtggcattgactctaaaaccatgtggcattcagaattcagcactgggcaatggcgcatatgctgatttaattttattagcctattagctgcatagacacaacagtgatttatgtgattttataatattatgttgaaccttcaataattgggattaaagtctggattgatgttgtaacagaaacaggagtagaaaaataatcatcagccagatggaagaaattattagttcacaaatgcagtgtgctcagtaataaaatctttcaaaatgtggatgacataggtgcaatagaatataaagaggccttcagtggaaagcttgggaagctctgcagagatgcagtggaccttgaaggttaagaatatggagtcagacaaaactaaattttaatctctattttgtgaccttgggcaagtaacttaacctcttttggactcagattcctcatctgtaaagtggagagaatgatgcagggaagggaggggagtgggtcaccgtgcagattcatggaaataaaggatagacagtggacacggtcagtttggctgttactatcatctgccagtagcctcagttacaataagccagaggcaagattaacatctcttcctttttctttctaattcttctgctccccacattgccataactactcccattttctctatctctgtttactcaatggcggccttctatcagtcagtcacataaaagtattcttattgcagtcatttacactttagtatgaatgagtcagcacttttttgcagcaattttcattggaagccagtgggaagtgaaaggctttggccacccctcataatatatgacttaaagcctgcttgcaatagagagcccttgcagagtctctaaaagaaaaggacctgccccctgaagaacttctgagaccatagacctcatggtgcccagcttttcctggttgccatgtgtcatctctaaagacagccatgaatatctgttttggttgacttgagccatttgaatgtctaaaacccatcttaataacaaaagctctttggagggaccctaattaacttctttaaattgctttctctaaacttttggaattaatacaatctgttcccttgttattaaaaaaaaaaaacaaaaccctaggatacttcgcaaaacttcccccaagttacttggcagctaacattttgtcaaggaggcatggtggccaaccttcccctgaatgggattggtttctatatagtcattccttccggctcatgactttcttctccatttgctgcccacggacgccgaaaataacttgttttctggcaagcttgggatgagattccttatgatttaatcagatccataatgaagctctcccagctttcaggagaaaacatcctgaactgcagggctggttaagggcagggccctggtgaagaggaggagccccctgcctgagcagcacatttggagccaggagagctgcaacagggccatgccacccacccagtggggtgcccccattgtggctgagactcctggcagtgctccaaggtgtgtaccatgtaagctgtgccttcccactccctgcagcccagactaaaggcctcaaagataataggcaggacatcgcatctgtaaataccagctgcttggtccaggaagagacagtttcctacatatatatatatatatatatatatatatatatatatagagagagagagagagagagagagagagagagagagagaaggaggaggagagagaccaggacagacttgccctggctgaaaccaggattcccttgatggttccaaactgatgttaaattagaggataactccagatatgataacaagctgggggtggcaaagtaggtgggtaatcagggagcatctgagtaggtgacagagaattggataatgaagaagcaggtaaggtgatgggaagtagctggggcaagagggagtagccaggcaataaggcaaagtagctggagaatgggagagtaacttgatgatgaaggccaggcacaaagtgggagttactgcagtggggcaacagaagacagccccagacctggggtagaggctaccctgacctgttccagttgccttcattttgccacttccttaggtcttgctgctgagaagtaaactcagcctaagtctgtaccagttagctggaatctgggctgttgtaaactgttgtggtgaagctccctgggagtgaggctgaggttgtagcagtagcaggtaggtgtggtgagtttatttccttgagggaggggctctctcttctctcagcccctcaaaggatgggtgaggttgcctgccagaggtcctggcacaactcacatctgagcccccaatttccccatcatcaccttcatccttctctcaaccagatttttattggataacttaagcaccaggcattgtgctaaaaatctttctatgcatcaactcattgcatcctctcaacaactctataaaataggaaccgttagtaaccccatcttacaggtggataaactgaggcttaaaaagtctaacaacttgcccacataagaggcgtagccaggactgtctgacttcagaatctgtcctctaagccttatgccacagtcatggttacttctacatggagcatttctccttcaaaagctcacccctacccattcactatttaacagcacttaacaaggtctggtttgggagtgaaagctcaggtagggtgtcctggttgggtaaggagcctcagaaacaattcaaatgctcatggtccccacctacggtgggcacagccacctggctgcccttttccaaacccattgcccgtgaggtctgttggataaagtcacagtttagaatcagtcttccccagggtgcacccaccactggcaatcagacctcatttgcactgagacatttatagtccacagtgaatttccattatctatatagaatgagacaaagaaacagaaggctcctggctttaggaagtttcttcttctctcttctgtctgacagccatcctttccagcatgtcttgggacagatgccatgtcaaggatcatctagatacttggaaaatattgtataattccaggctttataattttttaattaaaaaaattatgtttggatcctgaagagcctaactgtattccttatttaatgaaagcaatgcaatcgcattgtcactggtgacatggtccctcatttaataagctgctggctccaagataagccatccattccaggaggttcttgattggtaaaattgttttgcactaaaaggagcttaaggttaagcactaattaatggaagggggttggattttatatagatagatcggtaggtaggtttggggacatgtcaaatacaccatctttgtctctgcagctgaaaatatatatttaaagcccacacaactccgtagatttcttaaagctccatttttggcaagtatattccagtcttggtgtgctctggttaataagcagcttctgactcagggcactcagtgactgatggttgcattgacccaagtatctctcaggacgcaactgatgtggtcaaaatcccccaggtggtttgagcccaccagtctttctcggtggacatggcttgagaacttcagttgggcactaggacactatcttatctgaggcggccagaaaaaaaattatagactgggtggcgtaaacgatagaaacgtatttccttacagttctggaagccagaaatccaagatcaaggtgccagaatggctggtttctcgtgagggctctcttcctggctttccacctcctcactgtttcctcacctggtggtggtttgggggaaaggagactctctggtgtctcttttaaggacactaatcccatcatgggggccccatcatcatgacctcatctaaaactatctcccaaaagtcccatctccaaattccatcgcactggggatagggcttcgatgtatgaatttgcggggaacacagtgtagtctatagcaggcactttctgtggctgggcaagacagctgtcttctctgatgtccctggggttctctgtggtgctggagaaactgatgggggaattctctggaatttgtgtcctgggtggacacaaaggcctcaaaagctcgaagcccattcccgtggcctggctgcattgaaggaaactttactgctgattggaagagctatggggtcttcagaccctgccagaacacagggcatatcattttgtaggggagagccctagtcttggaaaacttcctggtggaaagcaaaggaaaggaggcagaggaaaggaccaaacctgatttattgggtaaatattaataaatgaatgtacctagtggctgccatgctcttctggcaatgagattggaggaaggggatatgattcagacccataaaactctggagagggcagtgggcttgtttaccaaatccctgatgctacccagagaggtgcccaggaacttgaagcaagtagggatgtagaaggaacctgtattattagggaggtgtcctggttctctattgtcacatagaaaagctattctaaaatttagctgcttaaattatctcacatgggtcaggggttcagatggagcccagaggggaaaatttgtctctgctccacaacgtccagagcctgagctaggatgactgaaacagtcatcctgtagtcccagggcctccccatgtagcctctctacgatggtggccttggcagagtcagacttcttggatgatgtctcagagctccaagagcaaatgtcccaggatccaggaagccgccagtttcttgagaccttggaacagctaccaagccgaccccgacttcagtggaagggaccaagaccccaccttctgatggcaggagtttgatggtctccactggggctgtctttaaactgccatgggaggctacctgctgcggcattttgaagtttatctcttgctcatgtgacagcccagcacgggtattcatgcttacttcagcctgtgggtggggaacggggagtgactgctagtgcgggttccttttttttttggcggggtgggggagggtgtgtgaaatgttctgaaatcgattgtggtggtggttgcaactctgtgcaaccatcaaagagggcagctctcttcaacacaatgaccccatgcctaggcttcttccatcctatggctctgcccgctagatcagagctgtccaatagaaaaagaattcaagccacatatgtaactgtatttatttatttagagccaggttcttgctctgttgcccagactggggtgcagtggcaaaatcatggctcattgcagcctcagactcctggcctcaagctgtcttcccacctcaacctcccaagtagctaggactacaggcacatgccaccacacctggctgatttttaaattttttgtagagacagggtcttgatatgttgcccaggctggtttgaactcctggcctcaagcagtcctaccacctcagcctcccaaggtgttggggttataggcatgagccactgtgcctggctagtaattcttaaatgcactagtagctacatttttaaaaggtaaaaaaataaacagttgaaattaattttaataatatattttatttaatccaatatatccaaaatgtcatttcagcatgcaatcaatataaaacttattaatgagagattttacattctgtttttttcatatcttttacatttatttatttatttatttggagatggagtttcacccttgtcacccaggctggagtgcaatgatgcaatctaggctcactgcaacctccaccttccgagttcaagtgactctcctgcctcagtctcccaagtagctgtgattacagtgccaccatgcccagctaattttgtatttttagtagacatggggtttcaccgtgttggtcaggctggtctcaaacttctgacctcaggtgatcctcccgccttggcctcccatagtgctgggattaaaggcatgcgccaccatgcccggctaattttgtatttttagtagagacagggtttcaccatgttggtcaggctggtctcaaacttctgacctcaggtgatcctcccgcctcagcctcccaaagtgctgggattacaggtgtgagccactgtgcctggcctttttgtatgtttttgaaatctgaaattgatgcaccatatgttgattcagattagccatatttcaagtgtcatggccacacatggctcgtagtcaccacatggggcggtatagccctggatcctcagagttccctcattcaggttggaggtggagattgcaggggagggatctgcaggccagatctggaagtggcaagttcagcccgcattccactgaccagaacccagactgtggtcgcacctttgcaagggagactggaacagcatctagctttgtgcccaggaggataaggaagcaaggtctagcgaacactcagcagagtctctcccagcagccagcaattttctgtgcatctactatgagctagtcagcctggttggcaggctgtatctaggttttgagtaaggtggaagaaattttgctttatatactggtttcccttagctcatagttcatactccttaaagtggcttccagggtcttccatgctaacttgcttcccagtgctcccaggggccccctgcaggtcccaatttgcacactgttactcatgctcttcctcccactgggagtatccgtgttctcctccagtagtgcccatcttccctgattctccccattccctgggtcctcttcagtctcttatgctccccttttatgcccttcaccatatacagacatacaggcagcatgagtggagaaacatgcagttcagaagcagctgggcctggattccagccccagttctatgacacacctgctgtgtgaccctgaggaaagtcactcaacctctctgagtctcatctgtcccctctgtaaaacggaaataaccagagctacctggtgggatgttggcccccacctgtcccagtgctgcacagctgcaggccaaagcccaacttggtatttgagctggttctgacctgggcaggccctagaagaggatgagaccccttcccactgagggaggtagatttgatcttgtgatgagatgtccttgtctatgagttgcctgggagagccaagactcctgtgtccctccaaagtgatggctccacctggggggctaggctctgcctcagggtcaccatccaacttttaaaacctttgtctagaagaatctcagcatggttaccataggaccctgacctgtccgttttcaccctgggatgggacatcttcttcccccccacccttcagccagcctgcatcaatctgctgttgccacttgaggatctggatggtgggccctggcctgctgcagttcttctttttttttttttttttttttgagacgaagtcttgctctgtcgcccagactagagtgcagtggtgcaatcttggctcactgcaacctctgcctcccgggttcaagcgattctcttgcctcggcctcccgagtagctgggattacaggagcctgccaccgtgcccggctaatttttgtatttttagtagagacagggtttcaccatctcggccaggctcgtctcgaactcctcagcttatgatccacccacctcggcctcccaaagtgctgggattacaggcgtgagccaccgtgcctggcctacagttcttcttttgcttctggtctcttactggactcttgtgaggctgacaccagccctgaccaagcccagtctccttggaggagaggcccaagtccagcccacaactgtgtagggccccccagccttgttgcctcccatgcctggcttcttgccctctctctaggggcagggcatgctgggctgtcttcctgaagcacccagaaaagttatgaggaggggacagttaatgccaggtgaccagtgaccctgagccagtcctcattgctatgttcagaagagacaaaggcaatgttagcatagtgaatgttgaactgggctgggtgccgtgaaaatgatataaggcagaaactataaggcggaggatactattatacacccattttatggaagaggaagctgaggtgcagagaggttcagagacttgctcaggtctcacagctccgagtgctcaagttgaattttgactcaatatcacatgaatgcccccgacacaaccctaccacctaaaaactaaaaggaagatatgaaagcaaatgtagagagaatatagctagtagccagaggtaaagtgaagagtcccaaagactcagaaataaaatcactgtctgaccctttgtccagaaaattcctgacgtaatggatgggcctcatcatcccgagaaacccagagtcagagtcaggaataagcaggtccttgaggaaatgaggaatgggatgaagaagaatgttcaggagggagagcatggccacaaggttgactgtggcctgccctagggtggggagtgcaaaagcaagatcttggagctcttgggttccttccctgctctcctgcccactccagattccatcagttatggcctttggaggctgtctgatctctgccctgcttcctggctcacccagccactgcttgtcaccaattcagcttcctgggtgttctgatgttcgaaagagggtgtgtgaatggtggacgagaacatcctggtctatatgaaggagtgggcttcagggtcagtagatacaatggtccccctacttagttccctggtgcttggagaccatcgtggtgctgggtcatgaagcagagagaacatttgtgggctctcccagcccagaactgaagcttctgaaccatggtgactctaggaagcccaccacccaggagtcagcctgcctccctggatgcaagttgcctctggtgcttacaaaccacagcacaaaacacaaaaaatgtggaaatggggacgttcccagaaggcaacttcctggggctcagataaccctggtctgaccgcagagacctgatgcacctcgtacttcccctcctgtctgtgaagcatgaacttggctggtgtcatgcctctgtgactcaaagatccctgctgacaggtttaactccctgcatggctgagcccctgcagagcccaggaccactccactaggccaaagtgaggggtaatggaaatgaaaactttccacgtttccgtgtctgtctccccgtagcctgagcccacaccatctgcctccttttactctggcatggatgatgggaaggaccaggccctttccaggttcctgttctggctcctctgtacagcagctgtgtgatcctgggccagtcgctttgcctatctgcaccccaggtttttcatctgaacagtgacggtcacagtaacacccacctcaagggaattgcgagaattaaatgaacctgtggatgtcatcctagaacagtgactggtatatagtaggtgctcaatagaggttaattcccatcttttctgctggggggcccagatgagatgaaggttttctgtttaatgaaaacgtgcacaaaagcccagcagcgctattcctagatatattcccccaagagaaatgacataagtctacataaacacttgtctacaaatgttcatagccacatttctcacaatcaccccaaagtggaaacaacccaaatgtccatcaactgatgaggggatacatggaatgcagtctagccatacaatggaatatcattctgccataaaaagaaatgaaggactgacacgtgctataccatggatgaactttgaaaacactatgttaagtgaaagaagccagacacaaaaggccacgtgttctagaactccactggtatgaaatgtccagaatagacaaatctatagagacagaaagtagattaggagttacctatggctcggggtgtggtggggaatgaggagtgactgctaatgggtatggggtttctttttggggtgttcagatgttctaaaactgattgtggtgatgattgtacaactttgaatacaattttaaaaaactgaaatgtacatttttaataggagaattgtatggcatgtgaattatgtctcaataaagccgtttaaaaatgaaaagtcagggagaggaagagaaacttactagcacttgctagtgccactggcttaaattgcttcctaaatattcacccatttcattctcacaacaaccttttgggaggtccttttatcaccccatttttgcagttgtggaaacagaagcacagaaaaggtgaagtaacatggccagtcacacagctagttagcagacctggaatttgaactcaagcagtggtggtttagaactgaaccgccaccgtaagctgccccccactgcaaccagaggtcggacttcatgtataacagagggagtcacaggacctcattcacccagaaagaccaccggagtcccccacctctcacagagggatctgccaggacttgggtgcacagggtgtagggcctaggtaccagcagagagccaggctctgagaggcagacaagaagtgggtgtttctgggtgacactgtgggactaacatgtctctgacccagtttgagagtgcctggcccctcctggagctggagctgcagaaatcgatttgcagactgccggtttccacttaattagcatggcctccttctggctgggaaaacaccattaaatgggctgggttggcctggaatcatgccggtggcctcggccctggttctctggggctatctgtctcttgggctctgtccccttagccaggctggaattcagaatggcccgagtttctggtttggagtatgaggcaaattctacccacgtccaggcccaagtgttagatgatcctggggccccggttgagggaactggaaggagaaatagaggcttcactcttcatactctgcctccttgggcccattggtcagtgtcctggcacacagacctctgacttgcacagggcacctaccctgtgccatgtacactgctgcattctttttttttcttttttttttttgagacggagtctcactctgtcgcccaggctggagtgcagtggcgcgatctcggctcactgcgagctccgcctcccaggttcacgccattctcctgcctcagccttccgagtagctgggactacaggtgcccgccaccacggccggctaatttttttgtatttttagtagaaatggggtttcaccgtgttagccaggatggtctcgatctcctgacctttgtgatccgcctgcctcggcctcctaaagcactgggattacaggcgtgagccgccgcgcccggcctgctgcattctttagatgcgtcacctggtacaccttccactcacgtcctgcacaggtgggctccacttcacagatgaggagacagaggtgccgaggggttgtcacttactgaatgttcccatggcagtaggtggcagggccggattcctatctccgggtctcctgcttctggtgtaatcccagcggcccctgcagagcctgcctctgttttgagggcaccactcatcaccttggctttaaaaagttgaaaagtggccaggggcgatgcctcacacctgtaattccagcactttgagaggccgagttgggcggatcatgaggtcaggagttcgagaccagcctggccaacatggtgaaaccctgtctctactaaaaatacaaaaattagccagacatggtggcgtgtgccagtaatcccagctactcaggaggctggggcaggagaattgcttgaaccctggaaggagaggttgcagtaaggtgagatcatgcccctgcactccagcctgggcgacagagtgagactcttgtctcggagaaaaaaaaaattaaaaataaataaataaataataaaaattcgagaggtttgatttctgcttctggtttcagaggaaggaaaatcacttaggcaatgggcccctggggaacagaatagctcctaaatcccgggtgtgctgtcctctgtgggctgagtgtctgtgcagcgggaagaaggggcacctctgggttctaccccagacttgctgcatgaccttcagcaactgacttgatttctctgagtctctttccctcatctgtagaatggggcacagtaacagcctcctttgcaatgtggatgacacagaatgccccggaaggtgcgttgacacatggtcagcgtcccgtagcagctgcctgttatctcgccagcactcttgtggctagcccttcagaaacgaacccaaagaaggcctgcttgctttttctcacaccatggatgtctggggtgtgaggcaaggcacatctttttcccatggaggggatacagcccgccatgcaggagatggcctgggatggagggtgggtctcctgggcctggagctcagcctctgtctggtgatgtcaggaatctgcactgtggagcagaggcaccctgcagtgtgcaaagtactggtgttttcttttaaattgaggtaaaactcacaaaacacaaaattaaccatttaaaagtgtacaatttagtggcatttaagtaccttcacaaagctgtacagtcatcacctctgcttagttccagaacattttcattgtcccaaaaggaaaccctggactcattagcagtcactccccagtttcctcttccccctagcccctggcagccgctaatctactttctgtctctatggatttatctgttctggatatttcatataatatgtgacttttcgtgtctggcttctttcacttggcgtaatgtttttcgggttcatccacgctgtagcatgtgtcagtacattattccttttacatctggatcatgttacattgtgtggatagaccccctgtcccccgccaaccacacacacccaggctggagtcaccctaaggtccacctctgcagtgatggttaaagcgatgtccccaaagggcactgtggtcttggctccttgatctcaccagccattcatgtccaaacatcagcctggtgctgatggggacgaggtggggagtgattctgggggatggggatagttaaagatccaccagggacagatgagcttcctgtgtggtccaactcaggagtcaccagggtccatggttcagatgctgggatctggagcgagaccatctgggctcaaatcctagctctgttgcctattgggtgaacttgggcaaaccattcaatctctctgtgcctcagtttttcttttggttaaatagaataataatacactacctacttaaaagggttgtaccagagctaaatgaagccttgctttagcacagtgcctggcacagaggaatatttccaaaatatgttagttgtccaaaatgtgttagcatttccaaaatgtgttagctgtcagctcttgtgattctttgattcttttttttccccccgagatggagtcttgctctgttgcccaggctggagtgccatggtgtgaacttggctcactgcaacctccgcctcctgggttcaagcaattctcctacctcagcctcccgagtagctgggattacaggcgcccgccaccacgcccagctaatttttgtatttttagtagagacggggtttcatcatgttggccaggctggcctcaaactcccgacctcaggtgatccgcccatcttggcctccctaagtgccaggattacaggtgtgagccaccacacctggccgtgattctttgattctatcagttggtgtttccccctaaaattgcagtcctgtgagtgtgctgaggccgtgcctgggcactatgcaccctcatagcatgggttgccttttcttactgctcctcccctgggctgttttccatctatttcagggctttcttgttactgtgcatcactgtgagctccacagagcaaaggctcactctggtttgctcagcacagtgtacacgccgggcacagtccctctgaacaactgcatgcccacaccactcctgcgtttcacctcaggaccccatggcccacccctgtgagctaagctcatgcctttttactttgagataattatagatttacatgcagttaaaaaaaatacagagagatcccttctgttctacacccagtttacccaaatggtaagttttttttttttttggagacagggtctcactctgtcacccaggctggagtgcagtggcgtgatctcagctcactgcaatctctgtctcctgggttcaagtgattcttctgcctcagcctcctgagtagctgggattacaggcacatgccacctcgcctggctagtttttgtttttagtacagacggggtttcactatgttggtcaggctggtcttgaactcctggcctcaagtgatcctcccgcctcagcctcccaaatggtaacattttgcaaaactaatatatgttatcacaaccagtaaattgacattgatacggttcaccaattggatccagattttgccagttttatatgcattcatttgtgtatggatgtgtgtgtttggctctgtgaaatctttgatggcaggagcagatttgtgtgaccagcactgcagtcaagaggcagaattatgaaatactggttacatgataaaattataatattttggacatatggattaggtaaaatatatcattaaaatatcacctgtttttattttttaaatgttgttaacaaaacatttcaaatcacatatgtggcctatgttatatttctctaggacactgccatcagtccaaaaagttcccctgtgtcccttcccagtcaatcccctacgctcttccaggcagctattgttctgatggtttttttccccactaaaggctatttttttcctttttgtcttttttttgaggtgatatgcacataaaaaattagccattttatttttttttatttatttatttttgagacagtcttgacgtgtcacccaggctgaatgcgggtggcacgatcttggctcactgcaacctccacctcctgggttcaagtgattctcgtgcctcagcctcccgagtagctggaattacaggcgtgcaccaccatgcccagctaatttttgtatttttagtagagatggaatctcaccatgttggtcaaactggtctcgaactcctgacctcaggtgatccacccacctcagcctcccaaagtgttgggattacaggcgtgagccaccgcgcctggcctatttttaactttttggagaactgccaaactgttttccacagtagctacgcaccattttatatcctcaccagcagtgtacaagggttccagtttctccacatgcttatcaacacttgttattgtctgtttttaaagaaattatagtcattttagtgggtgtgaagtatattgttagtttgctttttctggaaagtcatgcaagtggaatcacatagtatggaccctgtgtgagccttcatttgctcaacttatatgcgaagattttttagatgtgtggtttgagggcctggaaagtcatgtcctggcctatggaatatattaaaggggaagataggattccttaaggcaaaagtggcagttcattaaccccctcccctgcaaatccctgccccacccccatcccgctgccacataaagatggacctgtctgcctgccttcactgcagagcaaaaattttatttatttatttttttttttttttaagacacggtctctctctgtcgcccaggctggaacacagtgacgcgatcccagctcactgcaacctccacctcctgggttcaagcaattctccttcctcagcctcctgagtagctgggattacaggtgcccaccaacatgcctgactaatttttgtatttttagtagagatggggtctcaccatgttggccaggctggtcttgaattcctgacctcaagtgattcacctcaagtgatccacccgccttggcctcccaaagtgctgggattacaggtgtgagcaaccacgcccggcctgcagagcaaaaatttattgagcacctgtggtgtgccaggactcatttataagtaaatagaaaaggtccctgtccttgtagggtttataaactatagggggaaactacaagtccacatacacataacctaccatttaaaagtctgactaaatgctgtgaaggagtaagcaaggtgctttgatagggaacagagggacagtgtgtgtataggaaggccagtcaggtgggtccctctgaggaggtgacacttaagagacctgaaggatgagaactgagccagccatgcagaaggatggggaggctgggctagaggagagtgttctaggcagaacaaaatagcacaagcaggggccctggggcagtgaaagcctctggtggttcagtgcaaagttaggaaggtgtgaaacagtgggaagggaagggacagggatgctcctgctggctgatggcccatactgtaggggccacaactttgtcttagctgcaagcaggaccggagacatgaagggccagactctgggccaatttccttgctgcgttctcagctccaagaggcagctcggctgggatattgtggctcattctagtgtcttgcagcctctcaaactggagggctggagggttggggcgtggttagtggcagctgtgacggagacttatcaggaagcaggcatgtaattcctgcagtgattcacacccagtccccagtttactgcagtcctgcagtgattcacacctgggccccagtttaccgcagctgcacctttaaacagggctcggatgcctgcatctccctgacccgtgtgtaccctcatcatcccaggacctcggaggtgtgggtgaggcagcacatagctcagcctggtgccctcctctcactagagagcttgaccctaaagccgcaagctcaagcccacgccctggccaacctcctggagctttgagaacaaggtgtcctgtacacagagtcctggccccagtacctgagcgcacatgaaccccgtatgcaagaagaaaactgaccccagccccatgttacataagaacatctttggaatttggctccttttgaaatgaaatgggaaacctgcactcaaacaagcaggtatggggaattcaataggaggcaaatgccctcagggtcacctctgggccagtatgcattctgaggattggtttattcattcagcaaacattgtggacacctgctttgtgccaagcttcatggagggatacaagaacagatgttcaatcaatgtctgtgggaagaaggagagagaagggggatgaaagggaaggattgagaaggaggagtgtagggaggtagagagtaaggaagagaggaacgaagggagggagggagggagggaaggaaggagggagggaaggaaggaaggagggaggcaaagaaaggggaagggagggagggagggaaggaaggagggagggagggaaagaaaggggaaggaacagagggagggacggagggaagataaatgggcagagataccctcacagagctcatcgtcatgtgactgtgggtgcaggtgtgcccatggtaatgtaactaagtatttacaatctagctcagctctgatcaatggaaaaataatgtaagccacatatgtaattttaaatgttctaatagttccagtaaagcaggcaaggaacaggtgaaattaatttgaataattatttaactcaacattatttcaatatgtatttagtataaaaatattaatgggtatgttacatatctttttcacactaaatcttcaaggtcacccctagcacgtctcaatctggattatgcacatttcaagtgctccccagccctggacaccgtggagggtggcaggcactctgactgaggtgcacagagcctgctgagggcacttaagtcagagtcaaggaagacttcaccgggtggtgccttcagtcatttaatcatttgctcacttactgttcacctaatgtttattgaatgcctcctgcactgggtgtgacggctgggcagagactctgcttggaggaaggagggaagggcattccagactagggaagcagattgcaagctctgagagggcagactggcgtctgtctggttcactgctgtagccctgcacctggtgcagagttggtgcctggcgaacatttgcggagcgggaaaggagggagagaggagttgggcatttctagagcgcaggaggcagagaagactggttagagaggaagctggagacaccattctcaaacttgacagtgcactggaatcactggcagggtttgttaaagcgtagattgttagacacccccctcctgcagggttcctgatccagcagggctggggtagggccaccggatttgcattgccagcaaattcccaggtgctgctgctgctgctggtccagggatcactgagaaccactgggctagaccacgaaccctgtgaaggcagagaggagccaggagaggtttctgagaaggagagaggggagcacttaggtttgtgatttagaaaactgtgggtgtgcggcacggtggcgcatgcccgtagtcccagctactcggtaggctgaagcaggaggatcacttgggtctgggagatctgggctgtagtgcgctatgctgatcgggtgtcggcactaagtttggcattaatatggtgacctcccgggagcggaggaccatcagggtgcctaaggagggatgaagtggcccaggtcggaaacagagcaggtcaaaactcccctgctgatcagaaaactgtgcatggctgctgaggacaggggtttccacctccgtcccacctctcctgccagggcagtggcacccttagctcaggagggtgcgtcaggacccagttccatcctcacacggtggggaagcctgggctgtgctcccagaacaagaaacagacctgggtgatgagtgacaaatgtggacggttctctgcactgtgggtggaaatagaaacccttagtcagctgtggggttcagcaaagaatttccctggttaacggaaacttgactggctgtgggtgagggggaggttgggttctgagacgtctgggaggcctgggctcttcggttctcgtggtgcccagctcagcgtgatgccttcaggtttgagaccacttcctcctgttgagcctcttctctgggggcactcattatgtatgctgcgtaacaaatcaccccaaaaggtgttaagtgaaagtaacaacagatgtctgtgttctcacagtttctgtgagtcaggaacccggggtcgctgggtggtttgggctcagggtctctcaggaggctgtcgtcaatatgtgggccaaggcctgactgggttaggggatctgattctaagatggcgctcacacgctgttggcaggaggcctcactccctcactggtggtcttttcacaggactgctaagtccacactatgacagctggctttcccagaacaggtgatccaaggggcaagacagaagctgaaacatcttttttttgtttttttttttttgagatggagtctcactctgttgcccaggctggcgtgatctcagctcactgcaacctctgcctcctgggttcaaccgattctcctacctcagcctcccaggtagctgggattacaggcatgtgccaccacactcggctaatttttgtatttttagtagagacagggtttcaccatgttggccaggatggtctcaaactcctaacctcaggttatctgcccgcctcggcctcccaaagttctgggattacaggcatgagccaccgtgcctggccagctgaaacatcttttatgacccagactcacaaggcacactccatcctattggtgacacattagccctgttcactgggggagggaactggacaagaaggtgaatcctaggaggctggggtacttgggtggcatcttggagactgaccacaatgcccaaactgccctttggccttatcttgtagtcagtccacagatctccaaagataactgtatctggtgctgctatttgttgtcttggagcttgaagactgggccctacattcctgaggggtgcctgctggagccaggaggtggggtaggggagagccagctagtagctaaacactttactcattccagacactatggtcagcactttataatctaattctcagacaaccttatgagattatagtccccattctacagatggggaaactgaggctcagatagaggagatgacacatctgagatcaaaccactgggaaatggtggggtctgaattctgaaccactacacgtgtgtcttcataccaggtgcaatgcttaggtagactgcatattccccaacagtgtgctttgatggcttctctccagggtggaagtggttggagcaaaggtcagactggccctttcatcccttgggctcagagcctggcactaggcttgctggcagaagaggaaacaggaaggctttgggctgcatgcagatccccaactcttaaaacctggggtcaagtttggctctctcatacattctcatggtggagcaagcatgggtcaagtgtgggggtattggagcctcttaccagctgagtagattggggcaagttaattaaactcactgtgcctcagtatccccaactgtaaaataggagctcattagagcctgcctcacatttgccttgggctgttgtaagcattaaatgagatcatttcctacacatgctagactcagggctgggcaacagcaagtgctcagtaaacatgagctcttcttatcgcaggcttgttagatgctgatatgcatctgctgtctgttcccacatctggctgagctgtgaggatacgagggttgaagaccatggcatttttgtctattgctgggagcatcagcaaatgatccatcctgcaggtccgagagctcaggacattttcagcaaatggctcccaagtcccatacatcactctacctacatcctgtcctggtcctctctgagccaggaacagagggttccagaagccctggaaaacttgcagcttgctcccctccgggcccagccagctactctctagctgttcctgtctgataagagagtggatttttccatttcctgcagcagaaatgctcctgtttcctctctgcccacccagctgccctggtttctgctgctgcacgggcagaagatgggtatctggaagtcacaggagattgtgcagcatgcagggagagtagcaggacagggccccccaggcaggtggggctgcaaggcagtcagcataccttgcaggagccagacttctctgttttgttttgacatgggaaccgagtctgtatcagaaatgacaaaatcaaacacccgcaaacaaaaccccccagcgaagcaaacaggaagcagggtctggataaaaataccatcctttttgcagctgcagcctccaccatgcaggtttcagaaggtcacgctcttgacaggaaatgtggctgctttcagaggggagaggtggctgagttggggccgggggtagagacagtggggacagccagaagcaacagcaggctctcgggggaggttcgtgcacctttcacttcttgacaggtgaaggaactgggcccgatctgtctgttcccttcctggccacgatcccagggttcaccttggacttatatttgtttcttcctctcctaccagggaccaggagacttttattgtgagggtgaaatgagactgtggttttgaacttttttttttttttttttttgagatggagtttcgctcttgttgcccaggctggagtgcaatggtgggatcttaactcactgcaactccgcctcccgggttcgggcgattctcctgcttcagcctcccaagtagctgggattacaggtgcctaccaccatgcccagctaaatttttgtatttttggtagagacaggtttcaccatgttggccaggctggtctcgaactcctgacctcaggtgatctgcccgccttggcctcccaaagtgcttggattacaagcatgagccaccactctcagccattgaacatattttgttagctgaaaagcattaccctgaggatcagcaaagtttttctgcaaagggctagataagaaatattttcggctgtgtggccatatggtctctgtctaactcctcagctgtgctgctggagcctcaaaacagccataggcaatgcataacaagggagcgtgtgttccaattagtttttggacactgatatgccactttcatgtaatgttcatgtattgccaaatattactcttctttgatttttttcaaccattaaaaaaaaaatagaagccattctcagcttgcaagcagtataaaattaagccagatttggtttgtagaccacagtgtgccaacccctgcactctccaaacaaaatggtttgtattattgttgctatttaacttcctactcaatacaggaatcccagctttagcacttccttcatggggtcagccaggttgagactttgtttctgcactagctactttgagcagaaatagagttcttaccacttggctatcattctgcggaaggtttttgttttttagtgaaattgagaagttctgattataaaggtagtacatatggattttaaaatgcttgggaaatactggcaaacacaaaataaaaatccctgataaatcatagctactgtattttttttccaatgaaaagtgtgtggatgtatggaaagcatttttttcctttccagttgagattccattgaatgtaaagttttgactctttgtttttccattctatgttatatatcaagcattttcccatgtcattagaaattcctcaaagataccagctgcagaatattccattatatggatgtttcataatttaccaaatcaacctccaattgtttaggcatttgggttgcttccaggatttctcacttataaacaatatgcatataaacaatgctgctgtgaacatccttgttcgtaaatctttgtctgccctctgatcttttctttagggagaatgtgtgctgaaaattcctaggaaaactgtgcttctgacttatatactaacttttttttttttttgagttggagtctcgctcttgttgcccacgctggagtgcaatggtgcgacctcggcccactgcaacctccacctcccaggttcaagcaattctccacctcagcctcctgagtagctgggattacaggcacccaccaccacgcccggctaattttttttgtatttttagtagagatggggtttcaccatgttggccaggctgatctcgaaatcctgacgtcaggtgatccatccgcctcgggctcccaaagtgctgggattacaggtgtgagtcaccacacccagcctatactaaccatttttgctttactgaatttgactttgctgattatgcagttcataaggtttcctcactgataatgacttcattctcccctcctgcaccgctagccccaggcgaccactgatctgctttctgtttataatttcattttgaagtatctcatttttgatcagcctaaagttgattacctccttatttgctcagaattccattcttcataatagtaatgctgccacctccactttctttgtgtttgtgtttgcctgttttatatttgaacattcctttaattttagtctccgttattttgtttggaatatatctcttgtaagcagcacacagttgtttttttttttttttttttttttttttggcaaccaaatcattgctgctttatgggaaggataaatgattcaatttactcatctggtacatgtttggatgtcggtcatcttgcttcgtgatttgtggcatttatttcttttattatttctttcattttgtgactttaatgaatactgtgttgatttgcatttatcttttccatcgataatatggaagatacaagtagtgacttcaatttcttatgtggttacctttaaaattttcagaaatcttgttttatttccccaggcagacacttgttcatgtcctatgtaatacagggctgaggcagagtagcatctttaggaaagaccaaaattgaaagccaaggcagagacaggggaggtagttttgggacagcagaacaggaccagggaaatcagagggaagcttcagagtggacaggtgtgagctgaaggaacttcccccttcatacacagcttgttgccttttcctaaacattgataggaatggattttattcttggctatatttgagtgagggtcccttgtaattagtcatgcctgaaataccagttatgtatggaatcaaccagactagaatttgagtctcagtgcttactagctaaataatcttgggaaaatcatataagttatctgtcaaatggtctaataatagcacctaagtcatgtggttgttgtggggattgaggcatcccagggatctgggataatacatgtaacatcctggtacagtgccttatacttggaaaatagtcaatgaatgttagatgctattatgatggctgtgaagctattacagtgtttatatgcatgtatctcctacctgcagggctggaaatatttttatctattacttgcctggagatataaagtaaatggactatttttaaaaattcaggattgatagctggaaggagaagtgaggtgagagatgggttttagagagcaagagcgagtcagaaagaggcattcagggcatctggggagaggggaattgggataagagcagataccttggagagctcccggacggccagtgcgtgtttaggcgggccaggctctgcggagcggaagggagatcaggtccctaggtctgcagtgaagctgtaaggagaggtgctgggagaattctggaggtagaatcagtaaagaacaggggcctggtgcagcgggggtctgatgtatttatgaatagaatgaggaagttccaagttcgtgtttctggataagggggacccttgccttcagtctctgagattaagtacagtgaggggtaagagaaggggaaggaagggagaagaagagagagggaagggtccaaggcacacagtctttgcagctttggtggagaaatcttacaggcccatatcatcttcacggtagctgagttaaatgcagttctccctccctttgaggaaatcgaatacacaaatgtcccctcacacattaggaagtgattccccacctcaccccaacctccatgtgtcagaaagactatacatattgaaaaagattaactgcaggcctactttgtacatcagttttctgggtatctttagttttttattcttagaatttaaaaaaatatttttaatttgttcattcagtcaacaaatatttgttgagtgctttctctaggagctgcatgccccacataagaagacagacacgagttgcccgcatagagcttatatcctaaagggtgtgctgtcacttttcctgcatacacccaatgccagatgtaagttacatgtgcagaggcatctgggtagctgatgtgaatctctgtcaaccccttctgtctagcagagacatatgtcctgggcacagaggttctagaagggagcaggtttatagctacgtgtctggggtccccttggccatcttgtcctggtggtgctaagggtgtcagagatgctaggagaggaactggcctctttgttcaagccaaagggtgaagattctctctgacaaggaaaagtctgtggcccagcctgggaatgctcttgtccaaaggaagaagcatagagtagctcaagaacagatgttctggctggttctgaggcttgggtagaggccaggtaagctccattcacttctgcggtcatcagaaattgactgggggcctgaactacatcacaggagcagcacggtagccaaaagatggtcctactcaccctatccctccagaactttagtgtcgtaaagacacagacaaatccatacataactataaaatagtgttaagtctttttggagtttgggaggcacagcagtcatatgagaagggtgcctggcccagcctgggagacctgcaagaggctttgcagaataaatgacattgaagctgggacttggaatctaagtaagaattaaccaggtgaagtgaagacagagaaagacaggcagggctgggtgtggtggctcacgcttgtaatcccagccctttgggaggctgaggcaggaggatcacttgagctgaggagttcgagaccagcctggacaacatggcaaaatgccatctctacaaaaatacaaaaaaaattagctgggcatggtggtgcgcacctgtactcccagctacttaggaggctgaggtgggaggattgcttgagccctggaggttgaggctgcagtgagcttgatcacaccactgtactccagcctgggtgagagagggaccttgtctcaaaaagaaaaaaatactattccattgtatggaattttgtttatctattcattagttgatggaaatttgggtattactttagagatatcgcgactaatgctataaaaacattcatatgcaaagttctgtgtggacatatatgttcattcctcttaaatatatacctaggagtagaattgctgggtcagatggtaatgctgtttaactttttaaggacctgtcagtctgttttccacagtgctgtgccatcttacgttcccaccagcagggcccgagggctctgatttccacgcgtcttcacacggttgtccaacccctcctcttcttgaatgggccaagagtgatactttctatctggggaagagcaaggggctggctcctgggacctgaggcttggtcctggggatgtgactttgagggaagcccgtgtctttctggtccaccagggtgagtcatcacccaggatcccgggggagctgcctggcagaggggcgggctgcaccagccactgcagaaaccaccatgcaacttgactgagtctccaccctcagctccaggcagccgggcttccctgggagcagctatttctggctatttctgctccagggaggagcagtggtgggtggaaaggtttcaattgctcagtggggtgatttttggaagcgcagtgccttgggggcacaggacagctttgacttgggaggagagcagaggggctgctctgagagtgctggccctttggcgttatcagagcagagggctgggcacacagcagtcctgacagcaccttgaagagggggaaataagtcagtgcggactgggctgttcatgcaggaggtgcaacccagtgggcgggatgtggcgacatcaggcaggccaccagggtgcttggaagcaggggcaggctggggtctacctacaatggagatgcagcagggagaccgacagaggtggcgctggacctcaggctcagtgttcacttctgtgcctcagtgacttcatttgcaaatatagtaaccacaaaggctgcagcaatgcctgttggcaactgtcttctctatcacatgatgttctggaacactgacctttattggcaatgttcttgacctttctcttagctttttgccatccctgtgggctctcttcatgataacatctgtgtccatcctgttcttctctccgctgtatatgcttccttccctgggtccttgtttggtaccattttagcaaagtggttaagggttcactcttcggagctggctgggcctgggtgaaaatcccagctctaccattcccagccaggtgtctttgggcaaatcatttcatgtatgcaaatctgagcctcagttttcccatctgtaaactggagcaataatcgcagggagctatttaataacagcaggttacttatcctcgtaactggattatgaggactaattgacttgatggatatgaagggcttaacacaatgcctggcacacagttagtgctgggctgtagaaagagcaagggcacagggcagagagaatgaggagtgggatcctggacagagggacatgttgagtcccctgtatccagcctgcagagggggacagtgttgggtggggctgaaggactgctgtggtcagcctccaggtcaggtggtgttgatgagggaggctcaaggaagggtgtctgctcactcatttttttttaagtttgttgttgttgttgttgttcttgttcttgttttaagagacagcatcctgctctgtcatccaggctggagtgcagtgatacaatcacagctcactgcagcctcgaactcctggccttaagtgatcctacggcctcagcctcccaaagcattgggattacgggtgtgagccactacatctggcctcactcgattttgtacaaaagtcacaatcattgctttttattcctgagtcatactcctgttgtgccccatgtctgtgggactacactgacaaatagtttcatgccctcaggaacaagtagctccatgggtaacaaagtaagtgctgctgtaaaggacaaaagcagaaatgcagggtagtgtggagagaatagatggggaagctcaatggagattagggcaatcagggaaggcctcccagaggaggtgacattttggctaaaacctaaaggatgaagaagagtttgccagcccaagaatgggaagaaagaaggctccgggcataggaaacagtgtgtgcaaaggcctggaggatcagagctcggtttttgttttgttttgttttaggaaatgagaggccagtgtggctgaaccagtgagggattcagggagggatttccaggtaaggcaggtgtggagcaggcagggactagatcatgcaatgccttggaggcagtgggaggatgaggcctcattgctgggcactgggcaggaaaggaaggaagagagataggagggcaggccttgtgagtgaacctgaccctgcaagtcacatggcgaggtggcagcagctcagccccagggcaccccccggggagatgcagcttgcccaaggtccacctccactgggcagacacctctgcctggctgtctccgtttccccagaggaggagcaggagccacgcctatggtcgcatgttgctaaccatctcgaggtcaggaagatgctctgtgagacggagtgggtcagatgccaaagaaaacacaagcttgtcagcggtgatgtctccctgcaaaggcagccgccaccagcttcctgccgagatgggccggctcagcctcacttgctacagctggagatggagaggaccagatggccctgtttggcccagattccagccagattgccagggaggtgtaggcggagcagcggggtcggcgccaggagcagggatacgtgagtgaggagggcgggagccacctctttgccatctcagtagggccctgcctgtgtagggggtggcggggcaccgactgtggccttacagtggtctgtgaaccagcatatgctcagagctccctggagggagactgcctctgtcttttaccaccagctctaaagctcttgagaggtgcaagatgttgatggttgtattcccagcatccagcacagggtggcacacaagcaagagctcactggttgatttttgtttttatttttaaaataaatgctaacagtagccagggccttgtcttccttaaccccacagcaatgccatgagggagcactgttgtgatccccattttgcagatgaggacatggaagcagagaaggggaataacttgcctagagccgcagctaagcaaatgcatgagaataaatgggtcactctgacaaactgatggcagagcctgggacttggggctttgtgggcaagaagctgccctgagtgtgggcaactgagagaaggtgtggacactcctggccgaagggaataagcgtgcctttctcgtctttgtgctccctgagctccaggcaacaccttagacccaagccagcttcctccattgctccaggtgctccagagagcaagagatgagccgggagaggtagggagacaggacccctggcgtggctgagcaggctgcacactgcgtaattccagggcactgtattcacacagactatgatgagaacagtgcaaggtactgttatgcaagcgtatttgcatattgccttggaattatgcaaggcagtagctctgtaggcggaaccacaccatacaggactttgaagaccaggggtctgcaaaccttttctgcaaagggccagatagtaaatatcgtaggccacgtgagccatacagtctctgttgtacctactcaattctgctgttggagggtgaaagcagtcataggtgatatgtaaatgaatgagtgtggatgtgttccaataaaactttatttgcagaaacaggctgcctgccagatttggctcacaggccatagtttgtcagtcccaatgaaggtcatggaaggattttgaacttcatcccaagggcactgttggggctggacgtggttgtgcgtgcgcctggagtctcaactactcagaaggctgaggtgggaggattgcttgagtgcaagagtttgagtccagcctgggcaacatagtgaggccctgtctcttaaaaaaagaaggcggcggacaggcacagcggctcacacctgtaatcccaggattttggggggctgaggcaggcagatcacgaggtcaggagattaagaccatcctggctaacatggtgaaaccccgtctctactaaaaatacaaaaaattagctgagcatggtggcacatgactgtagtcccaggtacttgggaggctgaggcagaagagccgagatcgcaccactgcactacagcctgggcaacagagctaaactctgtctcaaaaaaaaaaaaaaaaaaaaaaagaagaagaagaagactgggcgtggtgactcatgccttaaatcccagcactttgagaggctgagatgggaggattgcttgaggccaagagtttgagaccagcctggtcaacatagtgagacccccatccctatattaaaaaaataataataataaaagaagaagaagaagaaaagagcagaatggagccacgagaaggttttaagcagggagtcagggagccaggtttacattttaaatggccctgaaagagctaatccctcagcagggcaacaccatttcttctgtcccatttgtgcatccttgaactcttctatcttcaagtagaggcttggcctgggattgcagggcgtctgatacatagagagttccagaagcaaaggtcactgctgtccatttcccattaccctcgtccccaaatcagctgtcagcacaggtctcgacgtggcagaaatccagaaatgctgttcctattcctggccttagggcagagtagaatggtccactggccaccagcctgggctttgaaatcagagaggcccggtgccaaatccctgctccttaatttggccacatgtgactaagctacatcttcctggccctctgtctcttcttctgcataagaggaataattataggtgtgaactcataaaataaagtggttctgaattgaccgaggtgcaaataaaaggcttagtaagaaaacattatttttatttatttatatatattttttgagacagagtcttgctccgtcgcccaggctggagtgcaatggtgcagtctcggctcactgcaacctctgcctcctaaattcaagtgattctcctgcctcagcctcctgagtagctaggattacaggcgtgcgccaccacgcccagctgatttttgtatttttagtagagacagggtttcgccatgttggccaggctggtcttgaactcctgaccccaagtgatccacatgccttggcatcccaaagtgctggaattacaggcatgagccaccgtgcctggccagaaaacattattaatataataataattttcttactgaactctagaggcagggagcccggttgtgcactgggcgccgaggactttgctcctgtgagtaggtgcagagccaggccttgggctcctaggtacattggaagtagcactgctgaggcagccttggctcatgagtactaagggcttcctagagatgggaatcatttgtcccacctcttgggctgaaaataactgcccaacatcagggtaattacatgacttggattcctccaccgcatggagaacaccccaataattactgtgcacaaacactgcttttggcagctgatgcttattttctgcctccaggagtatctcctggacaggaagcttattctgctacccaccccatgggatttgaacccctagctaatgtgagcagaaccatccagaaacccatcctagtcagggatatagtggccactgctcctctcccaaaagccatctgtaatgctcagggcacccccactcacccgtgggcaggttgggccttggtgatcagtggctttgccataatctcctacatggtcctgaggctaacaccaggcactgggtctgtaggagatgcctgcgagcagaggactgcctgctacagacatgagtcttctggagtcagcccttgagggtgatctgctttgctcagtgatggagaggctttgtccttggactgaactagagggctgccaattgggtcaaggtcctagaggagttcttgaggactcactgtgtaccaggctttagggatagagccataagtaccaggtcatggttctgcccttgtggggcttagtgtccaatgggcagatacactcaaagcccataattagttatataattgtagttgtgacaaggctgtaaatgagatgtataggagctatgggtatatataacaggagcctggggagtttaagctgagacctaaaggacgaggagtggggcaaaggtgtgtgtgtgtgtgtgtgttagtgttagaggcagatgcatggatgatggtggttggatggatgaatggatgctggtggatggatggatgaatgattgagtctcccaggcaatgggaacagactatgcaaaatctcagaggccacaagaagtgatgtgactctgtaactgacaaaagactattgtggaaagtgtttggagtttaagaaatgagagtggtgaggttagcaggtaggatgattgtgcacagctgagcaagttgtgtactggacagctccagaagatgccagtcttataaaccatgatgtggatggtgccacctagaattgtgcaagctagagacctgcagacagggctcacatcacgcaagaacttgtatgccataggaagagttgtggactttattcccagagcaatggggagccatggaaggattttaacaatttgtgacagagctaattttcatttataatgccccaaagcagcaccgtccaatagaactttccaagaagatgaaaatggtctatttctacactttccaatatggtagccaccaaccacttgaaactgagcacagcatgcctgagaaactaaattttgaatgttaattcgtttaagcagccgtaatagccagatgtagctagtggcaccatgttggtcaggacagcgccaaaggatctgaccgtactggacaaagtcctgtcatgcttaacccatactggctatgcatactgggcaggtctactggagatgccacctcttactgggtggtgacctcaacctccccttcacgcagggcctcggttcacactgaggcctagggtgcaactgggactgtggtttgggagctgggcctcatgaggatggagctgaggggctgtacccccaccccatccactgctcctgagcccttgaggactcctcccttgcctaccagcttctttttcccctggcaccccctggagttgctgactgggtttttttgtcctgcagaagggatagtcttctcttcaccctgcccagctcacttctaatttgtttccccacagcagaaatcaacgaggaaaccacctcagccctgccctatggcatgaaccgtagcgtggagatagtgtccacggtggggattaggggatgtggactttggcttctgtttcacagggagctagacttggctgggggtgggaggaggctcagagggctcagggccagcctatgtatcctgtctgcagtgcctgggcctgcacgcctggcttcatcagcacgatggcacgagggccacccacacaagccagcttgtgtattcaagttcgtccacttgccccacaaacagccaccctctgttcaccactctggcctagaggtccgcttgcccagtaactgcacagtctacctttgggaagctggatccagggaagatcctattgaggccctgcaagcaggctcggagtcatttggacagggacagtagaggtgtggcctggaaggggagccaggggcttgggtggactcgtcccactggccccctggactcctcatccacggggagaggcaaagctggagggcctgagatcaccctgccaaagccagagctggggtcccagttgccaagcctgggaaggggcctgcagggctggtgggtgagctcctctcttctctccctttgcacgtgggttcaggggagaattggggcttgaatggtggtgggcagaggaggagggaggagggtcacagtgataaggggagggggcttatcctaagcaagagggattccaggctgtcaatgctgttcactctggcctccctgcccacccagaatccctgaacacacacacacacacacacacacacacacacacacacacacacacacacacccctagacaaaattctagggattggggatggttaaaacctctgctaccctccttccccagggctcagtagggccaaagaaggggcatttgacacccataggtgagccatcacctgctgtggggacccacagttttagtaaaaatcatcacatctgccagagcaggagttcaccttcaaaccacatgctggccactgtgctgagcccctggcatggctcacctcgatgaccactcacactgctactgtgaggaggatgaacatcatccccattttgcagatgagaaaactgaggcacagagaaggaagtgtcttgaccaaggttgcacagccaatgagaatggtgcccaaatttgaacctccagagtgtatgctttcaatgactagaatgtgcatcctctggacaacaaatataacttgcttagctcagtgcctggcatccgggaagtgctaaataattgttagttcttgttattgttatccataataagataggcagtggcatctacctcttggaaattctgggcgtcagttgtctcatctgtaaaatggggagttgttactacattcttcataggcctgggggagagcgggtcttacccgggcccctgcatgcctgcacacccagtgtgcaacgggaagctcactcctgtaccctcctattgcagtacgctacttcctgaagaataaggtcagccctgatttgtgcaatgaggacggactcacagccctacaccaggtaaggccgggctcgttggggctccagggctccctgcccctcacctggacaggtaccctgtttctcggcactttcctgctcagaaccctcagggaggagggaatgagggagggaggaggagctgcagctggcccatctgaaaggctcttgtctactttggagatacgcgtgtctgttactgccatcccacagagccctgtgtgcgcccgcagacgcgactgcacatgcaggctctaaggacagggagcctttgttcactgcatccctcctgcccatgaaagcaagtgtgtttggagcttgacagtgtacgaagcacattcacacttatcaggacatcccatccaccctggcgacagaggcagttggcgggacttatgtgacctgcctgaggtcacatggtcttgatttatggtcttgagccatgtgctatcatgacatgtcctttccaaggcagagtgatgggtccagccctccctgctggggatggcttctctggctgtcacctttcacgtggatgctgctacagcctcgtaactggtccccagcattcagtctggctctgccataattctctgtccacgcagcagccatggggatgcttaagccaaaaatctcttcctgttactcaaagttctctggtgtcttcccataatctggggataaagaacaaactctgccacagtgcacaaggctgcacgaggctgggctcatgaccaatcttctaagcctcctggctctctgggctccagccacccaacttctcaggtccttgtacccagtgggctcctccccaccacacttcccacagcacttggtgctttcacccattagctgctgtccacagcaagagcctgggagctgtgctgtgatagacataccctttgtcttctgaaggccctcttccttcgtaattagtcattttagccattgatgtcatcacttgatgttgacttctcccctactcagacgctgagctgcctgagggcacagcacatacctcttgcttatgagtgtgtcctagcatctttccccatgctggcatacagtaggtgctcaatatgtgcatgttgaattaatgcatgaacacaccaaagcctccctgtgcccgagtttctaagcagatggacttgagtgagaggccaggcaaccagaaccctgggctggtgagggcctctccacctcggtacaagggcaggggtgggatgcacagagaatggccacgccctgcccgtaagccccaggggcaggtccctgtgtgtcctcttggcttctctctcacagggcctcaggcatctctcaggcagctgcctcagtacccccactccatctgccattggaaactcccagactcccagctccatgaaccctagagggcctgggactccactagggagcagagagcgggtggctgctatagcttgccctgaaatggagacccaaatgccaattcccaaggctgggctgcacccaccagccatgggcatgaggatcaaatgtgtgggctacctcctactgcgtgccagaaaggtgaggatgtcaggactgacagtcaggcttgtggcccggagctgtcacccactagctatgtgactgtggggaagttacttaagctctctgtgcctcagtttcctcatctctaaaagaggaataacaagtacccatctcattgggtggttgtgaggattaaatgaacacatgtaaaactttaagcagcactcgatactggataaatattattattatttattaaaagttattaaaatgtatcatgtgaccacttccctgcaaattacttcagttatatatttcatttttatccttacaacaaacttcagaaatattatcatccccaggccaggcgtggtggctcacgcctgtaatcccggctctttgggaggccaaggcaggtggatcacctgaagtcaggagttcaagaccagcctggccaacatggcaaaaccctgtctttactaaaaatacaaaaattagctggaatttggtggtgagtgtctctaatcccagctactagggaggctgaggtagggagatttgcttgaacccgggagacagaggttgtagtgagctgagatcatgccactaccctccagcctgggtgacagagtgagactctgtctcaaaaaaaaaaaaaagaaatattatcatccctgttttatggctcaggaaactgaggcagcctattcaatagaactttctacaatgatggaaatgttctgtgtttctgcagtgcacagtacaatagccaccagccacacgcggatccacagcactcgaaatgtggctgatgtgactgaggaaatggattttgaagtttatttaattttactggatttaaagaaacagtggctgtcttattataccgtgcaacttggggaggtgaaatctctttgtccaaggtcaagcagtgattgagtgtttaagtcaggatttgaaacaaggcagtcttaactgctctgtgggcaccacagctgcaattctctgagccccaggtcccctgttgagttgccatccctgcttgcaatgaactctcaagtggcaccctttttttagcttggggttcccgccacctcacatagtgcctcaacttcttccttgttggtcacattgctttctcaggaccagtttctcctgtgggttcctgggcccctggggatgcgtggtcagggaggcgggaactcgccaggctccgagtttagctgcatgaagctcctggctgaccagctgaaacccgcacctcaccccaaccaccacacgtgccttgggccccatgttggggcctttcagggagacatccaccctcattagcctgtgagcttccatttattttttcaacaaatacctattgtgtacccactccatgccagctgtcttctgggaacagggccccagaagtaagttaggcagagtccctgctctcagagttcagagtgtgctgtggccacaggcacataaataataatagaggtaatgcagtgtggtcagcccttgcacggagataggcaggggctcagtggcagcttaaaactgggaaccgatgactcgactcaaaggggaactgagaaagacttctaagaggaagggatatctgagctgggtcttgaaggatgagtaggagcttgctagctagaaaagaataaggcagaacattcaaagccgagggaatagcatgtgcaaagccttgagaaaggggctcagcatttcaagtttggagtctggagggttccatgtggcacagttagagagcagggagcctcagggagaggtgcaggtggtgagactgagagggttgagaacagggcctttggagtcagactgcttggatttcaattcatcttactccatgtgaccttgtaccaccaggcttccttgagccagtttccccatctataaaaggggccatttccccgtctgtaaaaagagcaatcctcataggcttgttttgaagattaaatgaggcaatgcatggccaaagcttagcaagctgcttgactcttgtaagtcctcagaaagcattagacattgttattgacaatgtgatgtgacatgctattactgttgctgccggggctgttgctattgttatcactgctattgtcactgtagctccagtgcaacaaaggagatgggggcacattaagaagagcttcccatgcctggcaaaggagtgtggattttcttctcttggcaacagggagccctcagaggtttgtaaacggagagcaacatgattagattaatgaagaagctctctctggtcgagggtgttaggaaggggaatgacggggaggtagggaaagatgatgaaacttcatccagggcagagggtggggacagcgatttaggagatgtgcaattcatacctggtgatagattgaagctgggaagggaggaagtgggaggaggcgggaggaggcgggaggaggcggctgactgccaggtgccatttcccacctcggccgcagcagaggaggaggcccgcccactccaccagctaccacccactccatgtgcgcccctgcacccagcccccaacgcagcccttattcaggccgggtctcccaggtgtagactggtccagcccctggacatctatctcacaagactctgccatctgggcacacagtcccctcgcccttcaaccagaggcttccactccaccccctatgtttcctgcggtctctaggggttggatttctggccctcttgcccctgaccccaggggctcctcagcggcatctcccagtgaaggcctggagatgctcaccttccaccgcagcctcgcttcgttgcctttggcgccctctgccggccgcgccgtgctgctgcgtggttctcccgcccgtctgaagcagcacccactcgcttacagggtcacacctttccctgcctgtccggagagaatgtcctcagacctagccaccgtcccccccgcacccccgcacccccgccccgcaaagaccggctggcgcagaaagaacctgggtctctggcgccatctgtgcaaacggctgctcctttcccacatgtcctggcgctgagccctggcttccctggggataggggtggggctgtggtgccgccccatcccacgcctacacccacgcccacagccacctggggccgtgggcttccacggccgctcctgctccttctgttggcgtctggactcttctctctatccctgtggtcgtttctggaggccaggccaccatcatctcttaactgggtggcttcaacacagctcctcactgtcccctcccaacgtgcacacatgtacgtgggcgtgcacgcgcacacacaccatctgttctccacgtgtaatcagaggagcagttgtttttaaaagcaattctgatcatgctccccttcgtagtgtaactcaatgtctcccattgcactgatgaccaagccccaagcccttatctgggtgggcagggctgagcctgtgagccctgctgtgtcccctgctggctttcgcagaggtcacctctagggaagagtttcatcccgcagtctgtaaagtggctccctgtctttctcctctctcccggcctttcccatcctggtgcctagcttgacgctcctctgtctccttgggatcttttcctccctgtccctggagcctgggggccacctgtgttggagcctgcgttctctctaggaggctgcaggctgctggcccttcccccttactggggctgccccacgtgccatcactgcagcatgtaggcaggaacacaaacatggctgtctcctcgcagggactatcaggacccctagaatgctcacgttgagctggattatttcagggggagtcttggttacctgaaggcttccccaagatctgagctacctggtcagaggttcctaagtcagaggtttcaagctatgatcttgaaaccgctttggaggccactgccaggaaaggggacaccctcccaacacacacacccctgcctcaacccaaccaatcctgtttgaatttactggtcatctaagtgagagttctccatataattttctttggagaaagccttttgggattaaaaaatacgttttaaaacctcattcaaaattttgtcccatttcactgatacttgcaaagcactttatagctgacagagtgttttttacctgtatatttttatcttacatattattaacttcatttttactcacaaggagactgaggcccagagaggttaagtggcttgctcaaggtcaagggcaatgcttacagtgtgaacatcatggagctggattcaaacaggccttccacagtcttcctcatggcctcttgcggggaacctggtgtgtcctgaccagggcccggggcccagtgccctgcctggagctgactctgcctgtgtgtctctcccagtgctgcatcgacaactttgaggaaattgtgaagctgctcctctcccatggtgccaatgtgaacgccaaggacaacgagctgtggacacctctccatgctgcagccacctgcggccacatcaacctggtgaagatcctcgttcagtagtacgtgcccctccctgccccagagcagcctccctccacctcttgtctttttccaacttccttctttctctcctccctccctccttccttctttctctcctcccttcctccttccttctttctctcctcccttcctccttccttctttcttccctccctccctccttccttctttcttccctccctccctccttccttctttcttccctccctccctccttccttctttcttccctccctccctcctttcttctttcttccctccctccctccttccttctttctctcctcccttccccccttccttctttctttcctctcttccttctttcttttctcccttcctcccttcctttcttccctcccttcctccctttctgcctttcttctgtctcccctcccttccttctttcttcccttcctccctcctttccttctttcttcctccctcccttccttccttctttcttccctcccttccttctttcttccctccctctctccctccctttcttttccctacctgcctccctccctctctccctcccttcctttcttctttcttcccttcctccttccctccttttctgcttttcttccttcctctcttttctctttttttctctctctctgtcactctttctcagtctctcttggtgcttgtcactttctttctccccacatcctctcttcatctctctctctgcttctacctctcaccctctcctcccctcagttcccctttactctccccatctctgtgtgcctgttctgctcttttcttcttctatctctgtctctccttcactcttggtctgtctctgtattttccagtctctttttattttctctcttctcctttcattctccctttccccccaattttttatagtgataaaacacatataacataaaataccatcttacccattttaagtgtgcaggttagtggtattaagtacattcatattgttgtgcagccattaccactctccatcttcagaatgactttcatctcgcaaaactgaaactctgtacccatcaaacagtaattcccattccctgcctacccctggctcctggcgaccaccattctactttctgtctctatgaatttgactactgtaagcactttatagaagtggattcagaaaggccgggcacggtagctcacgcctgtaatctcagcactttgggaggctgaggcaagtggatcacctgaggtcgggagttcgagaccagcctgaccaacatggtgaagtcccatctctactaaaaatacaaaattagccgggcatggtggtgcatgcctgtaatcccagctacttgggaggctgaggcaggagaatcgcttgaacccaggaggcggagtttgcgatgagctgagatcatgccattgcactccagcctgggcaacaagagcaaaactgcacctcaaataaataaataaataaatgaaaagtggattcagctgggtgtggtggctcacgcctgtaatcccagctactcaggtggtggaggcaggagaatcgctcgaacccaggagactgaggttgcagtgagccaagattgtaccactgcaatccaccctgggcgacggagtgagacaccatcttaaaaaaacaagaagtggattcatacagtatttgtctttttttgactggcatatttcacttagcataatgtcctcaaggttcatctatgttgtagtatgtgtcagagtttccttcctttttaaggctgaatgtactccattgtatgtctataccacgtttcacttatgcatccattcattgatggacacttgggttgcctccatgttttagctattgtgaatcatgctgtgacgaacatgagtgtacaaatatctcttgaaatcctgcttccaattcctttggttatacacccagaagtggagttgctggattgtatggtaatgctattttaaattttttaaggacctgctatactgttttccacaacatgttacattcccaccaacagtacacaaggattctagtttctccacatcctcaccaacacttgctattttctgctttttcttttttgttagtagccatactagtagatgtgaggtggtctctcactgtggttttgatttgcatttttctcgtgatgagtgacgttgagcatcttttcatgtgcccgttgtccatctgtatgtcttctttggagaaatgtctattcaagtcctttgtccatgtttgaactgggttgggtttttgtcattgaattttaggatttctctatgtattctggagatgaatcccttatcagatagacgtactattttctcccattctataggatgtctttgaaatcactgccaaatccactatcatggaggttttgttctatgttttctcctaagagttttatagttttaggtctttcatttaggtcatgggtccagtttgaattaaatcttatatatggtattgggtaaggatctaacttcattcttttgcatgcggatatccaattttcctacactatctgttggaaagatggttggtcttttctccattgaatggccttggtaccctgtctaaaatcatttaaccgtgtatgtgagggtttgtttctggactctattctattttattggtctatatgtttgtctttatgccagccccacactgtttgatgctagagttttggagttcgttttgaaatcaggaagtgtgaatccgccagctttgttcttctttttcagggttgtgttggctattcaggttccttgagattccctatgaattttagagtaagctattctagtctgcaaaaaacatcattggagattacaggtggctgacacctgtaatcccagcactttgggaggccaaaatgggtggaccacttgaggtcaggagttcgataccagtctggccaacatagtgagaccctgtctctactaaaaatacaaaaattagctgggcgtggtggtgcacgcctgtaatcccagctactcaggaggctgaggcaggagaactgcttgaacctgggaggcggaggttgcagtgagctgagtttgagccactgcacaccagcctgggtgatggagcaagaccttgtttcaaaacaacaacaacaacaacaacaacaacaacaacaatcattgtgattcttaaaagtaatggcaagaaccacaattacttttgcaccaacctaaataataattggtatcacccagagctgggcactgggcacacagggatgcagaagtcctggggagccaggaagaaagccaggggttttaagtaccagagctgagacagagccagaccagggggctgatcatctgagggcaaggagtcagagagagtggcccagggcaggtaaccttttgcactggtcttggcagagcggcaggagcccatcgttggctcccggggggatggatatgacagtactgctgccccagctcagagagctggataaacttgctctggggtgtacgaaagctcagagaagtcacagtggagggctgttaggccaaaggactggatggtggcctgtgcctatgtctctgatgggaacctgagtatggctaattctgctaggagcatcagatggccacagcctgatcagtgatggtgctaagaggacaaggaaagtggtgccagcctgggtcagtgggtcccaaagctgatcggtattacaatcacctggggcatgggtttaaaacagattcccatgccctaccccaaggactctttcaggagggctggagtgaagcccacccaagatgctgcattttattcccatggtccccaggtaattctgccacatggcatccagggccattcttaggaaccactggcccaaagggtaaattcttccaaggagtcccaggtctccattcttctacctctgtactatcagccttttgagtagggacttggaggaggtggaatataactgaggatgtttctgcatatgggcaaaaaatgaaatagaacatggagaagtaaaaagaactaatatgagagacctggttttgagtctggactctactgtatccaagctgtgtgaccttggacaagtgaccgaacctgtctgagtctttttttttttttaaacttgctctagtcttgctctatcacccaggctggagtgcagtggcgtgatcttggctcactgcaacctctgcctcccagtttcaagcaattctcatgcctcagcctcccgaatagctgggattataggctcccacaccacgccccgctaatttttgtatttttagtagagacagggtttctatgtcggctaggctggtctcgaactcctgacctcaggtgatccgcccgcctcgccctcccaaagtgctgggattacaggcttgagccactgtgcccggtcatgtctgagtctttgtttccccttgcgtgagatggggccaacagtattaacctgagctattataagggttaaataaaaggatgcctgcaaaaggggcttagatcaggtttggctctaagcaagtgcctggtaagtggtgctgctgccattaatgtgatttttgttattgtcaccaggaggacttttatatctgtccctaagtccctgcctgctggttcaacagagtgaaaggcttagggaggtcttctgggatagctgtcctgggactttggtctcttcccacctgggaccctgggatcctgaagctgtcgtgctcttgggctgtgtgtcaggcagatccaagcatcatcttgctggggtacaccttggtggggttttgagtgccgggttgtacagtaggattgcaggcgagaggccagagggcagaggcagctagaccaaccctagccacacctacttggccctcaccctgcctctttctctgcagtggggccgacttgcttgctgtcaactcggatgggaacatgccatatgacctctgcgaggatgaacccaccctggatgtcatcgagacctgcatggcataccagggtaagggagggcagcctgctatgaagtgagcacagcacagagttgcagagagcgtcccttaaatcaatgcaggcgaacagattagctacgcatcggcctgcctcgtgcgctgtgctcagtgaataggatgggtccccattcatatccttatctgtgtgattatcaagagcaggacatgagaggaccctggaaaacatgctgcgcagaagggaggtattgatctcattcgtgtcacccacacacgcaggtggccgcagctggccttgtctcatcttcatcagctgtgacaatttgattcaataaatgttcaccataaagatatattcctatgtgggacaataataaagtcaagaatactggagggtgcctgctctgtgccaggcaccacgctggctgccaggggcccagataaacaagatgtgggctgttctcaactcacaaatgaggttcagaaaggaaacagatgcagcaatgagagacctgcgtgccccagcaccccacagatagacctctgaagcgccacctccttggaaatatgtcacatccccagatcctcagctgcagctgcagtcctgccctggccctgcccttgtgtaccccacagagcctcagtaaccgtgattgaatgtcttgttccttgcacccagatcttcctattcatctcctgcagaggttcttaaccatttttgtgccaatctggtgactctatggaccccttctcagaataatgtttttatttttttgagatggagtcttgctgtgtcccccaggctagagtgcaatggcacaatctcggctcactgcaacctctgcctcccaggttcaagtgattctcctgcttcagcctcccaagtagctgggattataggcatgcaccaccatgcccagctaatttttgtatttttagtagagacaggatttcaccatgttggccaggctggtctcgaactcctgacctcaggtgatctgcctgcctcagcctcccaaatttctgggattacaggcgtgaacccccgcgcccagccagaataatgtttttaaatgcagttataaaagtataggattataaaggaagccaattatattaaagcgtaagtaccaaaacatttttcaatgtgttagatagaaacttcgttaattcattaaacaataagataacaggatatgaaaatagctatagtatctgttggtaacaaagttacaggcactgctaacactactgtgggttttgcttacattctaatggtagggaatactcaatttcgtttaaagcttagtcaaaagaaatgtgtgattttatttcctccttttgtagatctctcctgaattcgatcgaacagtgcttggtctaatggatctttttacggagcatgtcatcctctccttaaatactgtttgtagctgtcagtaacacacttttaagacaggaatgggattcgggctatacaatgtctctctgggcccctacctcaattgactcagctctccacttgaaagtaatacattcattcattcagtccttctgcaactaaaattgattgagcgttgtgccaggtgctacagacacaaccatggttaagatgaaggaaactaacagagaccctggtcagatagggtggtcagcagaggccagcttgggagatgatccagtccaggacctaaagaataagacagaggcagccatctgagcagttggaggtgtgtaggtggatggtaaggactttcaggtagaagaacagcatatgcaaagtgaccaatatgaatccattgcctagtgggtgccaggcaggaatgcccttgctctgtgggccaatgcatggtgtctcatcaggcctgaagacaatgatctatgggcatgtctgcatgcccgcttgactggcatatcctagggaacaagagccatgcctccctcatctgccttcccctgccctctggggtcgtaggcctgagggtgctaaataaatcccctctttcccactgcaggcatcacccaagagaaaatcaacgagatgcgggtggctcctgagcagcagatgattgcggacatccactgcatgatcgcagcgggccaggacctggactggatagatgcccagggtgccacactggtgaggagatgggccagtaccaaaaccaagaccagctaggtccgaagtgggccagcacctggtggggaccaaccctgtacccttggggcctgtctgtgaccttggacctccgcaagaatccttttgggccaggattgcccctggatagggagggtcagcagagcagggctcagcctctttgagaacctggcctctctctgggctgggcttggtggctcacacctgtagtcccagctacctgggaggctgaggtgggaggatcacttgagcctgggagtttgagtttgagttgtgattgcaccaatgcactctagcctgggtgacagaaagactttgtctttaataaacaaacaaacaaaaaagaatccagccactctcaagtggggcttggagttaggagcctgggtcggagacctggctcccacctgttcaccaactgctctgtctccaagatattccttcaccccaggcttcatgtgtccatcttgagctccttatttccctctcctctaatgatgtcctccattaaggactggtgtcaccattcacccactcactcgtgctttcttgctttgcactgtccattcccctgccttagtatcacctctcctaccctagcaccccactgccttgcctcatcagctcccctgatattactgcaacagcctctcctttgggttccctgacttcagagtctgcccaccactcccagtcatccattcatccattggtccatccaaccatccatccatccatccatccatccatccatccgtccgtccgtccgtccatccatccatccatccatccatccatccatccatcattccatccatccatccagccatccagtcaacacacagttatgagcacctcctctgtgcacatactttactagaccctggagacagagaacaatgggaccttcttctctctcaaatccgcctggttaactccactcatccttgcagctcaagtgtcactgacttaggaaaacctccctggccactcctcataggctctcagagcacactgcagcctaatattggggaggtctgcttctgcaacctgtaagtcaaaattcagagcatggctatggcagcctaccccactgactggggggtgggtgccctgtcccaggcttaggttccacgctggtcgtaagcactcagcagtctcgggatctcgagctcactagatagggctcagcagtaccagatatcctcactgcccctcaggcctgacctggcagcccaggtgtgataagtgggcttctcccacctgcttcctgagctctcacatctgttttatgcccatttctattacttgggtgcctgcttggatcacctgctcagcctagcactcaagaatggggtcaggtaggaagtctgactatttctgtctgaagtcaaggccaggctgcactagggcattacccagcctcattgcagctccaatggggctgtcattgggtcctctagacacagggatcttctctacctgggctggggctggcctcagggtggccccacccccatgggctgggcatatactaggtctcaggtcttcccagtaaactggagatcatagtgtcttcctcacagtgttgctgggagcattaaatgagattctgtgtgaaagtgcttagcacagtctgcaaattctcaatagatgttagcaatgaccattatttttactaacaatgccactattccactcataccttttcatttccagccaagtagtgaggtttgtaatgtcggactggccagcaggtgtcattctctacaactgacaagcatcagacatttataaatcagataattatactaattttcacatcatacccttgctttttcaagttggaaaaaaaaaaagcttcaagcaaccttctcccaggatgaggtggcatctgaccatcagggctgtgttcagaaggatcacttcctgaggccatgccttctttgtcccactgactctccagcccaagacctcaggcccccgaggttctctggcttcctcccagctagtcttctgctagccgccttggactctcacttctatctctcatcttggctgggcagttgatgtctttttgccttatttccttctctctccttcattcattctcatggtcatcatttaggactctctaagaatgtgaatcccttactgagtgttcattatgggctaagctatttatgtattttgggggcaaattgaacaatcatgacaactgaggtctgccaggcagtggccatgactgaaggccttgaatgggatcacagtccctcattggatgtattatctattgctgcataacaaactaccccacaatgtagcatcttaaaacaataataaatatttattgtctcacatggtttctttgggtcagagagttaggaacagcttaactgggtggctctggcttggtggctctcatgatattgcaaccaagatgttgcaatattgttgagactactggggctgcagtctcatctgaaggcttgactggtactggaagatccacttccaagtcagttcacacacatggctggcaagttagtgctggctgttggcaggaagcctcagtttctcacctctttaggacctctccttgaggcttcttgaggatcctcacaacatagtggctgccttcttctagaataattgatccaagacaacataaagtagaagcagaaatgccttttatgccctagcctcagaaatcacaaacaggatattcacaatatcctacttgttagaagtgagtcactcagtctggcccacattcaaggtgagaacagtcaggctccatcttttaaaggaagatgtgtcaaagaatttgtagacatatttaaaaatcaccatattgaacctcagagaccccttcttcagggctcaatgcacagtaggggctcagtaaatgctatcgctttaaccacatggatgctaagaccaaccacaggggagaagaattcagctctctacctttccttttaagtccatatttcagacttaataatcctctgcaatgtgactggtatttccatttcattctattccattctactggccccaaggatgctgtgggagttgggtgaaggtgagagctagcctaccgtcaatgtggggctgatcccctgaggaatgctcacttctttcctctcctccagctgcacatagctggagccaatggatacctgcgggcagctgagctcctcctggaccatggagtgcgtgtggatgtgaaggactgggatggctgggagcccctgcatgcagctgccttctggggacaggtagttctcacccacagggctgtgggggaggccggcacagggctaacctgctgacaccaagttttttgggctggcagttgttttcaaagaacataagactttaaggcttaaggtgttgaatatagctcatatgtgggatatgaaaaggcctagggagtttgcaaaaaacattggacaaagcaagttgtgttttttttttttttttttttttttttttgagatggagtcttgatctgtcacccaggctggagtgcagtggtgcaatctcatctcactgcaacctccatctcctgggttcaaacaattctcctgcctcagcctcctgagtagctgggattacaggcatgtgccaccatgcccagctaattttttgtatttttagtagagacagggtttcaccatgttggtcaggctggtctcaaactcctgatctcaggtgatctgcctgccttggcctcccaaagtgctgggatgccaccatgcctggctgacaagttgtgttctaataggatggtaatcaaatttgccaaataagaaaattaccagcatttttgcttctagcagtttctccatttgtttccagatacaaaactctgattgtcacttacacctagtccctccttagatacctgccagctctagagttacagccaactctttcttctccttcttcttggtgtggcccaggcatgtggaggaggtgctaagctcattgcatctgtctggattccccccatggctctagtttgcaggccttccctggaaatcaactttgtcccaccattctttgggtcacatcctaagaggccttgggcactctctccacctcctaggctttctgagctctgggcagggggacacatgagcttcttcctgtgtttcagatgcagatggcagagctattggtgtcccatggagctagtctcagtgcaaggacatccatggatgagatgccaataggtaagtccagcacaatagctggtgtgcacaaataggcagttatcaatgttttgatgggtagagggagaaatagataaatatatggttgtatagattgatggattggtgtctagatagatagatggattaattaatggatggtagatgaatggacggatggacagattaatggatagatggataaatggatgaatggatggttgaggtggtagatgggtagatattatgaggtctggttgaatggatgggtgggtgggtggatggatggatggatggatggatggatggatggatagacagaaaaataagtggatgagtgggtaaaggatgaatctatgaatacatggctcagtcagcaataggtagatagatggatgaaggggttaggtagaatagatgggagtatgtagctttattagcatctttgcataatttattgcttgggctatgtggggtacctgcttggggactcttcttggaaactatcaaagagcaacatgaatccctcggtcatagctgggaagcttaggaattgtgactgtgcccagaacctgggtttcccattcttataatcctcttataaacacactcactcaactttggctggcattgttttcttgcctccctgcatgccctgaaagatgcttggagttttcagtgggttggggtggcagctcctctggtctggagcaccctcttgcgccacaggtcctggccccgtcccccacaacagactcctctgccccttcagacctgtgcgaggaggaagagttcaaggtcctgctgctggagctaaaacacaagcatgatgtgatcatgaagtcacagctgaggcacaagtcatccttgagccggaggacctccagcgcaggcagccgtgggtgagtccggggcagggcagccaggagtccctgtgtgtgctcctgcctgtggtgcctgggtgcagcctctaggacccactttgtcctctcaggaaggtggtgcggcgagccagcctgtcggacaggaccaacctgtataggaaggagtatgagggagaggccatcctgtggcagcggagtgcagctgaggatcagcggacctccacctacaacggggacatcagggagaccaggacagaccaagagaataaggaccctgtgagtggcctcacgccctgccctagtgtcagccactgcaatgggaggagaacagggcccagcctggccttgcctcttcaactgagagccttcagagggaagtagccaggcactgcccttaaactagcatatccagtctgatgatgatggctactgtagttaaaccagcagattcagtctgatggtggtggctgctgtagttaaggaggtgatcggggagtgtgttagaggctgagctgggtgctttggcacacaggtaggtctcctaattgacagggggtgagtgtccgctatgcgcctagctgtgctccagcacacctagcagtggacttccaaggagagagcttcagtagggcagtcacccaggagctgagggtgctacaacttctttttcaggaaatataacaagatattgagaattgtgtttatcagaacatgttttttgaaaaatggagtaggatcctagtaggacctctgagaagcctgctcctgtagcagccaatggtcctttaagctttaagctgctttcatttctgatggctgctttaagaaattatcacaaactggatggcttaacatggtggaaatttattctctctcagttctgaaggccagaagtctaaaatccaggtaacaccagcattggttccctctgggggctctcaaggggattctgttccacgcctctgcgagcttctggtggctcaggcgttctttggctcttgctagcaatgattctagtctctgcttctatctccacatgacctttttcttcgtgtgtgtgtgtctgttttctttttttatttttattttattggttttttttgagacagggtcttgctctgtcactcaggctggagtgcagtggcatgattatagatcactgaagactccaactcatgggcttaagcgatcctcccacctcagcctcccaagtagctgggactataggcgggggccatcacgactggctaattttcaaatttcttgtagagatgaggtcttgctgtgttgcccaggctggcctcaaacttagcctcaagcaatcctcccaccttggcttcccaaagtactgagattacaggttcgagccactgtacctagcctgttttttcctcttatgaggacaccagtcattggattggagcccatgccaatccagtatgacctaatcttaatttaatttattacacctgcaaatacctatttctagataaagtcacattcagagattccaggtagacatgaatttttgagggacactacttaacccagaaccaacacactcactcagcatggctgctttcttgctgagtggagtgaacaagtttggggctggagtggaattgctgaggatgagggagaagttaactgtaccagaagtggtctgccattttcgttcttccactacaccacgaacagatgaaaacatgcctagagagtttagccttggtgggatgaaattgattagctaccgagcatgcccacgtgtctcagagggaccctgcttcccagcacgaacagtggggtcacctactgcctgtctcaccaggaggtgtgaaggtgcctgcccaaggggaggccacatcaaagccaccagctggtgatggagagggcacgtagggaagatttgttctgcctggccccttagtctgaggattggtgagaaaagagatgtagatcagtatcaaatcacatttcagatgtctcccagctgtgctttatttatttttcctttgtgattgtggtgtaacttaagtatggtaaagcagacaaatctttttttatttttttatttttttatgatatggagcctcgctctgttacccaggctggagtgcagtggtgtgatttcagctcactgcaacctgtgctcccgggttcaagcgattctcttgcctcagcctcctgagtagttgggattactagtgcccgccacgacgcctggtggatttttgtatttttagtagagatggggtttcaccatgttggccaggctggtgttgaagttctgacctcaagcaatccttacccacttggacctcccaaagtgctgggcttacaggtgtgagccaccatgcctggccaagtagacaaatcttaaatgagattttcaacaaccttttacaaatgtacacactcagatgaattcatagagcattttcatcatccatgttctctctccgtcctttcccccactccaaatgtagtcactatttaactttgagttctaaagattaattttgtatatgcatatgaatgaccctgcagtttctttcgtgtctggctttttttacatctgtgagagtcacccacgttgtggcatatagcagtagtttttttttgttttttttttttgagacaggagttcactctgttgcctgggctggagtgcagtggtgtgatcctagctcactgcagccttgacctcttgggatcaagcgatcctcccacctcagcctcttgggtagctgggactataggcatgcaccaccatgcctggctaattaaaaaaaatttttggctgggtgccgtggctcatgcctgtaatcccagcactttgggaggccgaggtgggtggatcacaaggtcaagagatcgagaccatcctagccacatggtgaaaccccatctctactaaaaatacaaaaattagctgggcatggtggcacgcgtctgtagtcccagctactcaggaggctgaggcaggaaaatcacttgaacccgggaggtggaggttgcagtaagccaagatcgagccactgcactccagcctggggacagagcgagactccgtctcaaaacaaaacaaaacaaaacaaaacaaaattttttagagatggaatcttgctatgttgcccaggctggtctcaaactcctgggctcaaatgatcctcttgcctcagtctcccaaagtgctgggattataggcacgagccactgtacctggcctcattcttgttttttttttctttttctttttttttttttgagatggagtcttgctctgtcccccaggctggagtgcattggcgcgatctcggctcactgcaacctccatctcccgggttcatgccgttctcctgcctcagcctccctagtagctgggactataggtgcccaccatcacgcccagctaattttttgtattttcagtagagacggggtttcaccgtgttagccaggatggtctcgatctcctgacctcgtgatccacccgcctcagtctcccaaagtgctgggattacaggcgtgagccaccacgcctggccgcctcattcttttttattgctttctagaattcgattgtttgaatattaaaatttacatatccatgctcctttttttttttttttaaattgagacagagtctcgctttgtcacccaagctagagtgcagtggcgtgctcttggctcactacaacctctgcctcccaggatcaagcgattctcctgcctcagcctcctgagtagctgggattacaggtgcgtgccaccacgcccggctaatttttctatttttagtagagatggggtttcgccatattggccaggctggtcttgaattcctgacctcaaacgatccaccctcctcggcctcccaaagtgttggtattacaggggtcagccactgctcctggcctccattctccttttggtggacatttgggtttcttgtttctggctcctgtgaataaagctcctataaacatttttgtacatgtcttttggtggacataagcactattttgtgttgggaaaacacccaggaaagcagctggagtcacgggtaggcatatgtttagctttagtggatactaccaagcagttttccaaggtgccttgtacctgtctgctttcccatggcagagtgtttcttgccaacccttggtatagtcagtcttttttttttttttttttttgatacagagttccgctcttgttgcctagcctggagtgcaatggcgccatctcggctcactgcaatctccgcctcccgggttcaagtgattctcctgtctcagcctcctgagtagctgagattacaggcacctgccaccatgcccagctaatttttgtgttttagtagagatggggtttcaccatgttaaggtgggaattctcaaagcatggtccctgtaccagcaacatcagcatcacctgggaacttgttagaaatgcagactttggctgggcacagtggatcacaaatcctgtaatcccaaaactgagggaggctgaggtgggaggatcttctgagcctaggagttactggacaacatggcaagaccgtatctctaccccccaccaaaaaaaaaaaaaaaaaaaacaattaggtgggtgtgatggtgtgtacctgtagtcttaggtcttgtgaggctgaggcaggaggattgcttgagtcgaggaattcaatgctgcagtgagctatgatagcaccactgaactccagcctgggtgacagagtgaggcgtggtctctaaaaaaaaaataaaaataaataaatgtagattctcaggacccactccagatgtggcgatactgctgcacacaagaatttcagaaccacttatttgaggaataatttgttcagcctgacccccaaatcacatttcttccaaggctgtgccctgttagccttcagggatgactttggttcactgttttttgtttttgtttttttcctctgagacaaggtctcactctgttgcccaggctagactggagtgcagtggcgcaaacttcgttcactatagcctctgcctcccagattcaagcaattctcccacctcagcctcctgattagctgggactacaggcacccgccaccatgcccagctaatttttgtgttttttggtagagatggggtttccccatgttggccaggctggtctcgaactcctgaccttaagtgatccacctgccttcgcttcccagagtgctgggattacagacatgagccactgtgccccttgttttttaatctgatgtttaagtagcagtacagacaaactaaatcagaatctcaggagttgggacctcagcattgtatatgtttgtcattggtgtttttttttaattttttttagatggaatcttgctctgttgccaggctggagtgcagtggctcaatcttggctcactgcaacctccgcctcccaggttcaagtgattttcctgccttagcctcctgagtagctggaactacaggcgcacgccaccatgcccagctaatttttgtatttttagtagagacggggtttcaccatgctggccaggatggtctcaatcccttgaccttgtgatccacccgcctcgacctcccaaagtgctgggattacgggcgtgagccaccatgcctggccatgtcgttgttttttaaagctaaagagagactgtttttgaagtgattgcagcagtaagtagaatgcatcgaccacagaattggcaagatcttggaggtcaaggagaaaggagttcgtttcctagggaggaagacagaggctgcaaggactgagggttgggggtgggatgagcaggtggtgtaattggacagttgaccaggaatgtgtgtctggtggtcagcccatttccagaacggtcttcaggagagtttttctgcattgcagtgcttgtttaccctcagggtgagtcaaagtccaggatcctgtggggaggggagcagcttaactaaaatttggttaaatcatttaccgctgggcgcagtggctcacgcctgtaatcccagcactttgagaggcccaggcaggcggatcatctgaggtcaggagtttgagaccagcctggccaacatggcgaaaccctgtctctactaaaaatagccaggcgtggtggcaggtgcctgtaatgccagctacttgggaggctgaggcaggagaatcacttgaacctgggaggcagaggttggagtgagccaagattgcaccactgcactccagcctgggcaacagagtgagactctatctcaaaaaaaaaaaaaaatcatttagcaagcatttaatttcggttgataaattgacagtttaatcatttcagaggaaaagaatgagaatttgggggactgtgtttgggttgtcctaggaaaaggaggggtcgtctgagcgttctggaaatcctatggggaagggtgattctgtgcagtcagccattccccagaacacaaaatgtgggggttttgtttaaccttcctgttgtccagtatctcagttcaacattgccaagatgatggtgcctaccacaaagggtgttctagggtcaattgtgttcttatttgtatagaactcagcccataatttgtacctcattaagcattaggcagataagtacatttagaagttccctgcatcatgagaaaacctctttcgtctaacccacatccttcaggctggagttaattcctcttccttcaatgctctgatttctgacactggagatggatataggtgggttttgttttcttttgttgagacagggtctcattctgacagggtcactcaggttagactgcaatggtacaaacatggctcactgcagcctcaccctcctgggctcaagtgatcctcctgcccagcctcccatgtagctgagccacaggcacgcaccaccatgcccagctaatttttaaatatttgggtagtgatgaggtctcactatgttgcccaggctggtctccaactcttaggctgaagccatcctcccacctcagcctaccaaagtgctgggattacaggcatgagccactgcacccagcagggatttttttctttttaaactaatagattttttttttccgagcagttttagaactctagaaaaatgagtggaaagtacagatatttcccatatacacccccctccaccctggtttcccctgttattaacaactagcattagtgtggtacatatgttatcactgatgagccaatattgatacattattatgaactaaagcccatagtttacatcgggtttgctctttgtgtcgtaactcctgtgggttttgacaaatgcataatgtcatgtgtccgtcatgatagtgtcacacagaatgctctcgccacttggtttaggtggttatattagacagttgagattgtgaacaactggtgaaagagaccagggctgtcccactaaacagccctggtattctacttacgcttcctccccaaactctagcaatcactgatcttctactgttttcataagtcttgcttttccaaaatgttatatacgtggaattatataatatgtgatgctttcagattggtgttctatatggtttttttttgagacggagtctcactttattgcccaggctggagtgcagttgtgcaatcttggctcactgcaacctctgcctcctggttcaaacaattatcctgcctcagcctcctgagtagctaggattagaggcctgcgtcactgcgcctgtctaatttttgtgtttttcttttagtagacacaaggtttcaccatgttggccaggccggtctcgaactcctgacctcaagtgatccatccaccatagcctcccaaagtgctgggattataagcgtgagccaccacgctcggcctgtacatgtttttttttaactgtctagatgatgccaatgtgcatccaagatgggatcagtgtctcagatctttgccactctaagcatcagcaggaaattcttagaagtgccaaattgcaggccccaacccagacctattgaatcagaatatggattttaacaatatccctaggcaactcacatacacatcaaagtttgagaagcactgactaggaccaccaagaaacggtctctccatgacatggcatcagtctgcctgcatagttcagaaggagccattaaaaaaaaaaaaaaggttggactcggtggctcatgcctgtaatcccagtgctttgggaggctgaggtgggagaatcatttgagaccaggagttcaagaccagcctgtgcaacatagtgaggccctgactctaaaaggagaaagcgaagaaatacacactcataaatggaaacttactatggaaagtgttctttgccttatcacatattaccatatatatatataacatatatatgttatatatgttatatatgtatgttatatataaatacatatatatgttatatgtacatatatgttatatatgtacgttttatatatatttatatatgtatgttatatataaatatatgttagaaaactagattataaactagattatatatatatatcttggacatctttccatgccagcttgtggagaattccttcattctttttgccagctacagagcatgccaatagaagtactggccacagtgtcctgcttgcccaatgatgactttcaggctttgcactaatgagagagaaaatctgtgaaatgggcttgctggtgcaaagtatacaatcttttctaaaaatttttatcattattattgtttttattttttactgaagagctggggagagaagaaaggaaaaaaagaaaaaaatttcagtgaaggatgatgcaaaactgtccatcaaagagactgtagcaatttacattctcacttatttccccatacccctgccaacactgagtaataacacactttaaacgtatttgtcagtgtgatatccaaaagtgatattttgttgttttaatttttatagtattaacgattagtggggatgaatattattccaatgccatgtatatctatatattttgctgtgggctacatattagtatcccctgcctactatttttattgggtagataggcttttaaaaattgacttttggctgggtgcggtggctcatgcctgcaatctcagcactttgggaagctgaggagtgtggatcacttgaggccaggagttcaagatcagcctggccagcatggtgaaaccccatctctacaaaaatacaaaaatttgctgggtgtggtggtacgtgcctgtaatcccagctactcgggaggctgaggcaggagaattgcttgaacccgggaggcagaggttgcggtgagcagagattgcgccactgcactccagcctgagagacagagcaagactccgtctcaaaaaaaaaaaaaaaaggacttttaagagctctttatacttttagaaaattagtctcttttctgtaatatatgttgaaaatattttcctagtttcttcatgtgtcttttgaccttgttccctgttcatggtgatttttgctgtgctttaaatgttgttgcatgtatctattttttagtttatagtttttaggaagcagctacttttcaaactcttgttatccaaggattattaggtgtacaggatccctgggtaagaatctttgtgagatatgcttcatatacagaggaaggattacaagtgactgaaaaacccaactcaaatggacttacacacaaggaatttattggcttgtgcaactgaaaagtctgagcctggaaggatcctggacttcaaatgggtcatcaggatgcagtctctcttagcctttcttcatgccaactttacttgcaagcagacccttcaacatagtatctccccagccctcagcttacgtcattcttactacccacagttcctacagaaacttctctttcccagttgttctagcaaaagtcccagggttgcttcactgaagcaatttcagttaagaactcatccctgggccaatccctgtagtgaaatatgttgactagctaggccttgggtcatgatccaggccctggagcaaggccaggggtcggtcaactgtacggaaattcatagattgggggttccccaaaggaaaaccctggccccgatacccagggagagaaaacagatagaggaaaagtccaaacaataatgccctcagcagagagacaggtggatagtaggttcagatcttccagccagctggtaatgttgtccttctcactcgcagaaccccaggctggagaagcccgtgctactctccgaatttcctaccaagatcccacgaggtgaactggacatgcctgttgagaatggcctccgggctccggtcagtgcctaccagtatgcgctggccaacggggatgtctggaaggtgcatgaggtgcctgactacagcatggcctatggcaaccctggcgtggccgacgccaccccgccctggagcagctacaaggaacagagccctcagacgcttctggagctgaagcggcagcgggctgcagccaagctgctcagccaccccttccttagcacacacctgggcagcagcatggccaggacgggcgagagtagcagtgaaggcaaggcccccttgatcggaggcagaacttcaccgtacagcagcaatgggacctcggtatattacacggtcaccagcggagatcccccactcttaaagttcaaggcccccatagaggagatggaggagaaggtgcatggctgttgccgtatctcctagtctccgtgtgatggaggagggagatgcctggggaggggctcctggaatccaggccagcccaacagccctggctggggaggtgtcagggcagctggggagaggtgggctctgcttttcagaggaactcagaccccagccctcagctggctgcccatagcatcccatgtcccacgtcccgtggttctgcttcctgctgcatcgtctgccatctgacacaaggcctgtcgtggcctcctggttcactctgctgtctgatcttgggagggtgggcttgagatcccagctctattcttggtataaaggcttctccggatcagtacatgcatgtcacattaacacacacacacacacacatatacacacacacacaagctcgatcagtgtgtgtaggaatgacatacctgggctcaggggaagcaagggggcttagaatttgtggggtattcccaaaaggatggaagttaagactcagagtctcattaccactgccaatgtggttttagcaggggaggggacctgctaagctgagacccatagtcctgctcagagttatcccaaagtctgagccaccagccacacctgacaggggtgagaagtcctcgctgtgttcagagggagccaggaatctacatgggtagatgagatagacacagacctgctccccgcagccttgttgagagccacacttctgcccatgccaggagccagctgtgtgaccatccaggggtggagggggaaaaccaggcaatttcgttcctggaatcaaccaaatcatgttttcctcttggatggaagtgtcaaaggcagaagggtgtgggagggggacaaggtcagtatttaccaaagtgtatctgattttaaaaattcctttagtctgtaaaactcctagagggagggaggtaactgaattcacttctttttgtggatcgtatcaaggtcactgggttttactggctggtgctgggaaaatgaagctaagtgaggagcttccattggaatgcttttccagggagagaggccagttaatttaaaaaaaacagtcgctagttaacagcgacagagcccagcaccctggggtctttgtgaatatccagactgtttcagcccagcccatctcagccaaccctccttagactgagctgtcagagcaagcaattaggggccagcctgcctccacctcccacccccttccacctccatcagtcatgtgtgcagagtcagtgctcgggatcccgggcccagcttttgcctttttggggatgcttggtgagacagatttgccagtcagcccttttgagttcccgcctcacccaggggctcccagcctgcacttgcaggagtggtgatgccccaagtctgcgaatccagggtgcacgtggtcaatatcccctcctgcattcaggagagccatggtagggctagagttgggtcttgcccagccctgcagtttcatagtcccagccttcctggtgctggggagggaggactgtgaatggctgttctcccctcactgctgagtctcccaggaccccctttggagatgcccatggcatgggcactgcccacaggctcagccagaacctcttggtgtacccgataagctgcaggttatcccttgctctgtgcgccttttatttgtccttaaactacctccttagagctctgaaggggtctcctagttccagattttaatttggggaacagatctgggttctttttaaccctcttctttctcagtctatgagaaacttgccctgaggggcacctgggctaggggcttgggactggaagaccatccccgccttgtgccacaactttggtcatgggatctgctctttgtcattcttagccccctactgtggcccccatagccccataacccagagagggagctggacttcagggagcctgagtgatgctttcccaggagcagggcagctggctggaccagaaagtagagggcccatgggagtgactgcacccttggtggctgctggaaggggagaggttctcagcatcaggccacctccaccccaatgccaggatagatgtattctagagtaggggtggaggcggcccaggaggctgaagacaggtgcacagatgcttcccacgaccttgccatttggggtgggctcttcaacatctcaggctgtggctggaacaggacaggatgatctaaaacacacgtaccattggctgtaaaacagtatgagcccagactgacgctgaaatccctcatgagccaaccttagctacaaggtagggagttctgagggaagccgcgtgctcctcaggagagagctgtttaggttttccgatctttttgctcaggggccaaacactgaaggcacgtactgcccaacccactgagcgcctgaggccattccctccttttccgcatgcctcctgcctcctgggctattcctctccacccagaaggctgggaatcccagctgattccctgacaggagccgacttcacacacaggtgactctcaggcattggctcatgttttcagccagggataaaccatcccttcttggggctttaagtccctggggagctttccctgtaggtctcctgggtgttgagagacaagttggagaccaacctccaatgaatgagccgcggtcattcattaattcactcacgtaatttactgagtagctgcaacatgccagcctctacgttaggttctgcggataaaggaggaataagacagagtcaggagaactgttccttgtggtttccgtcccttggggaccacaggcatcagcagtcccattcaagtcacctgaggcaaagtgtctgcatcttcgtccagcgaccctttgcttttcggctcctagaatccttagagtctgaattcctttagctgggaacagctgtcatggtcacccctggataacatttgccaccaagtatagatgctggatcttgggttccaggcagacatcatccaggtccatctggaactttcagtgatagctgccttcagccagcatctttgggggactctataatagcagcttgagatcagtgtctagaagactgttctgcaatttgctgccaaatgcatctcaggtttttaaagtcattgtttcttgctcatggtggctcatttattacatagtcccctcaccccactaatggataatgggaggaaaagttgctgcttccttcagcatcaaagcctttccttgggaatctgcctccctccatggcaggggtggattcgggagctgggagtaaccaggcaaagtcaaccagatgcctagctcctgctgagacccaggtcctatggcagctcctcattagattaaaggagaccacttccaaagcaggtgctgcatggctcaccatcatatgccccaaacaactgaaagttggcggttatcaccagactgtgagtttctggcaagtagcttggggaagctgaataaactctaggcccagggctactaaagacttcaggatagaattctccatcaaatatacagcataagtaaaactgctctgcactgtttaatccatttccaaggggcttagaaaagctaacaagggtgtgtcccctgtcctgccccaccggtttgctggctttgtaataacataagaccattgtggttgttggtgtcagataccttcccatcctgagctctctcacctacctgctctctctcctagagcaggatactggggtacttttaagaagggtgctccttttaagatgcccagaaaagctgtatttaactcttgctatttgtaacttggggatggtctcccctgccccagggcacataagagcaaaggctccaatggtcagtggatgactctgcaaaagtgaccccctgtgccagaagctatagccctctccccaacaggtctctcttgttggccagagggcctgcttcccatgggcattgcaagtgccaccgtgcggggcctggctctgcacacccaggaaaagtctgcagacccccagccctccgcaataattcaccagaccagaagccactggtgtacagagaacacttaaaaaaatgtattttatgtgaaaaaaaattaaaactctgtatactgtatcagcagctttgtgtaaaaatggcaatcaagagagtctaatatatttaaaacttttttaaaaaaaatcttcgcagatctttgatatcgtactgaggtaacttccacgtagccccttgccacgcggcaccggtgggccttgggtccaaaactgtggctcagccacatcccaaagggggcacatgtccctggagttgcttccagctgccaaggcctgtgacagaattcgctgttaagagtttttaattaaaattattaaattccttttaataacacctgctagtgtgagtgattattgctgtgagctcacttgaacagtgctgacttgaattcacaaagaggaggttcctggaatagagggtgggtgagagctcctagtctcttcccccttaccccacccctttcccacagagggctttcccatgagacccctgaaatagagggagctctgggggctcagacctggagcagatgtctccccagactaggagatggtgaaaactgatgaattcaagaaaaggtgggtggttgggaatgaccttcattctgtcaaataatctctttgaaattaacatgaggccgtatagtagcatatatttattccatacattttcaaagtttttcctgatatttatttatttatttttatttttttaagatggagcctcactctttcacccagtctggagtgcagtggcgtgatctcagctcactgcaacctctgcctcccgggttccagcaattctcctgcctcagcttcccaagtagctgagattacaggcgctcgccgtgatgtccagctaattttttgtatttttagtggagatagagtttcaccatgttggccaggctggtctccaactcctgacctcaagtgatcctcccgccttgagctcccgaagtgctgggattataggcgtgaaccaccacgccccgcctctcatgacatttatatgtaacaagggtgcccctctcctctgtcccattcttggagtgaactgacatgtcctgtcctcttccccctgccccattccactctttcccctcgtgtgcttattgtggggaagtacgatactataaagtacttcaccttatgacagcaatacagcagctaaggccccggccattctcattttttacctcgagcattaaaggcatagagaagctatgtggttgcacagcctcagaccacagtccttggtccttgtcccacacagaactttgttggtgtttttcttgaaagaggatgaaaagggtgtcggatcacaaggtcaggagttcgagaccagcctggccaacgtgatgaaaccccatctctactaaagatgcagaaaattggccaggtgtggtggcatgagcctgtaatcccagctactcaggaggctgaggcaggataatcgtttgaaccctggaggcggaggttgcagtgagccgagatcacgccattgcactccagcctgggtgacagggcaagactccgtctcaaaaaaaaaaaaaaaaaaaaaaaaaagaaggtgctctcttgcagcctcccggaccctggataccagcgcagggacacatggaagtccccacacttattcttgagaaacttcacaaagggatggggatggggagaggagaggtagagagggagaggcgtctcaacagcggcaggcattcatccatttaaaaaggttattggttgctaaataataatggtaacatctcacatttatgacccacttttcatttacataaaaaagatgacgactgaaaattgactgttggatttagctctgtggaactcatgatgaacctgacaagaggttttggtaaagcagtgggggttttagcctgattgaagagggctggaagggaactggagacagcaagtatagacaactggtttgagggtttcttttcttttcttttctttctttctttttctgagacagggtcttactctgtcacccaggctggggtgcagtggtgtgatcatagttcactacagctgcaaactcctgggctcaagtgatctcttgcctcagccttcccactggctgggaccatcatgagcactgccatgcactaaaagttaggcgcaccaccatgcccagctaacttttgtatttttttgtaaagacagggtctcactatgctgcccaggctggtctcaaactcctgggctcaagtgatcctcttcccttggcctcccacagtgctgggattacaggtgtaagtcaccatggccagccacatctgagattctatgctgcaaaaataagaagtgagatggggagctttagaggaatgtagggtcaagagagggttgttttaagatgaaaaatatttcagcatgcttgtaggctgatagaaatgaatcggtaaagagggaagctgatgttccaggagaaagaagaagattgctggagcgatgctggtgagtagtagaggggctggaaatgcccaggcagaggggttggggttggatgggcacaggcacagttcatcaatgcccagtatacgggcagagatgcagacaggaaggtagactagatggccgcacgtggacgttcccttcttactgtttctgtgttcttgctgacatggaagacaagctgtcagagaggaaaaggtagagagaatgagggaaatgcggcctaccaggcagtttttttgtttgtttgcttttgttttgttttgttttgtttttagatggagtttcgatcttgtcgcccaggctggagtgcagtggtgctatctcgactcactgcaacatccgcctcccgcgttcaagtgattctcctgcctcagcctcccgagtatctgggattacaggcgtacaccaagacacctggctaatttttgtatttttagtagagacggggtttcaccgtgttggtcaggctagtctcaaacgcctgaccttaggtgatccgccctcctcggcctcctaaagtgctgggattacaggcgtgagccaccgcgcccggcctcctagcaggcagtcttacggattatgaatttaaaacatgaccagtcagtaagcatggttacgctctttttgttttttcttcagccctgtagggctgccggggtgcaggtggaaagtagggtataaccacggttggttggggttttacaaggcaaaaatcgatgaaatgagagaagactacccgagggtgtaatcaaaggagcagtcctaatacgatgagccggtattctttgaatgaatgaatacatggttaaaggcaggtgataaaggcgatatggttggccatgccaaagcactgagagcctaggagcagcgtggccagagtctccgggagtcggcacctgcctctcctcgttgtctaggcctgactgtccctggccttgcacggccgcgcagcggggcgaccggcagggggcgcgctgggatggccaggagctcggctctccccgctctgtccctgctctgcggcccgcctcgcccctgcaagtttaaattcctcttagcaagcccagcatcgcagccaataacgcatcagggggcggagccgtagaggcttgcgccccgcctcgctccgctattggaaggaaagcagccaatgggagagccgaggcggggaggtgcggccaatggcgcgggcctgtttgattcaaaggttgcctataaagcgggactgcacgccggtttttgtccgagggctgtcgagtccgagcgccgccatggctctgctgtccgagggcctggacgaggtgcccgccgcctgcctgtcgccgtgcgggccgcccaacccgaccgagctgttcagcgagtcacggcgcctggctctggaggagctggtggcgggcggccccgaagccttcgcggccttcctgcgacgcgagcgcctggctcgtttcctgaaccccgatgaggtgcacgccattctgcgcgcggcggagaggccgggagaggagggcgcggcggcggcggcggcggccgaggactcgttcggctcctcgcacgactgctcttcgggcacctacttccccgagcagtcggacctggagccaccgctgttggagcttggctggcccgccttctaccagggcgcctaccgcggcgccacgcgtgtcgagacgcacttccagccccgcggcgctggcgaaggtggcccctacggctgcaaggacgctctgcgccagcagctccgctcggcgcgagaggtgagcggccctccagggccctgggtcgcacgggagacccccttcaagaatgggaaattgaggcctgctgggagtacgggccggggccactacctcctctgcgccctaccggaagcgcgcgcgggctaggtggtcccagggtctccgactcacaccccactctgcgtgtctcccccggatcccccgggccgctcctcgtggcaggggatagtgggaaagcctcggttcccaaggatgcgaattgtgcccgggttccatctcctaacgttcatatccctgaaggagggaccagaagtactctgagttccaaatttcagttaaaatcaaacttggaaaattgcctatttccctgtctgtcagccaacgctagatcccactttcaggagcttcttaggagactcattaccaaagaacttacgcagggaaagttccagaaagatggtctccagagacaactacggggcattaggaagcaattattattgctaattactttcatgcatcttttgctgtaaaaagcagataaacacgagagtggcaaagtgagagccctgccgctttttctttcttgtcttttttttttttttttttttttgagacagattctcttttgcccaggctggagtgaagtggtgggatctcagttcactgcaacctccgtcccccgggttcaagtgactctcctgcctcagcctcccaagtagctgggattaccggtgcccgccaccacgcccggctaatttttgtatttttagtagagacggggtttctccatgttggccaagctggtctcgaactcctgacctcaggtgatccacccgcctcggcctcccaaagtgctaggattacaggcgtgagccaccgcacccggccccctgccgctttttctactgccagagactggaggggaaactggggcaaggggtttgttttccataggctgggtctgtgccagattgcagtggtctcctaaaatgcagatacatttgcattagatcggcttctgtattcatagtgggttttggtcctactgtctgactcttagtatggcatggtcatgggtgcaatggaggtcttgtctgcttgccagcctcgataaagctgcagcagggtgctggggatcaaggaggaagaaggcagcctgcaggtgggtgtggcacatagagtgtcgtggcagacaccttggtctggagccatggtcaggttgcttgctgactggcagtgcccagctccctggctatctgcctgtgccagggacatggcagataaagccccagccatgttaagacttgttagggctggtacctgagtgtgtctgagtgtgggtgaagataccagtgcattgtcaggttgacatgtccaagccccgactctcaccaatgttcttaatgttctttccctgactggtggggtttcagtggtagtggatacagtgacctagtgccttgcctttgagggagtggttgtgggctgcagctaggctcttaccagccctgaggtgctttgggtggactgagggttttttgatgcagcagacattttccttgcgggttcagtgaaaagattaaaaagatggaaaaggcagacttgtgtaggtatgcatccccaaagctcatgtccagtagaacttgagcacttggaacctgaaaaatgtaaagaactggtctgtatagtgagagctgtggattgttctagtcttttgcccagccccaaattttagtgatagcaaaagggcactggaactagaggccagagggaaactattaaactcacgtgctggcgtgaggaggggatggagccaggagctcagactctccctcatctcacgggcattttgtaatactgacatttccagatagaacctgctgccctagtctagctacccacagttccctccgagatgctgtatttggaacctgggcagttttaactgagaaaggtggtacattacctttaaatccaatgagtattggctgggcacagtggctcaagcctgtaatcccagcactttgggaggctgaggcaggcagatcacgaggtcaggagttcgagaccagcctggccaacatcgtgaaaccccgtctctactaaaaatacaaaaattagctggacgtggtggtgcgtgcctgtaatcccagctacttgggaggctgaggcaggagaattgcttgaacctgggaggtggaggttgtagtgagctgagatcacaccactggactccagctctgggcgacagagcaagactccctctcggaaaaaaaaaaaaaaaaaaatccaatgagtattttcagtgtgtccgatagatgccaaattatttgcttactcattgcctgctgtgtatcagacactaccatggctggggccacaggggaaggcatcatccttgccaacacttgagagtggacagtgtgctgatgggaaacagtgaggagtttgctgcaggtactgcggaaagggctaaagaaagaaagtctccggagtggcagtgacctcagagctgggtggggcttgccagacctagggtatgggggctggcccacaagtgtttaaggacctggaatgtttgggggcagccaaattccccacagcgggttagtggtaggagaggaagctggggtaagggatgctgaaatgagttgggtttgagacagtgctgaatttgaggtcccaaagacaatctcttttgtttaaaaaaaaaaaaaaaagccaggccatggtatcatgtgcctgtagtcccagctactcaggaggctgaggcaggaggatcatttgagcccaggagtttgaggctgtagtacactatgactacgctgtgaatggctactgcactccagcctgggcaacacggggagaccctgtctctttaaaaaaaaaaaaaaaaaaagtaatgctttctgtttgccaggcactgttctaggtgatcccaaggaaggtgcgattatcatcttcattttacagctgatagaactgaggcatagagaagttaagtggccccgaagtcatgcagctagagaatgaaggagcctgtactcaaattgaggcacagaatgtctgaaccactgttaaccaccacactccctgtggagggttcaggagcctgtgctcaggtggggagaggtgacagcagatctggtggctagctaagagctactactatttatgggcatgcattgtggacaagggagtggctgtgtcaccttgaccacatcctttgaaatctagtacctgtgacagcgaggaccatgaaggtgtaggtctcaggctgctttcaggatgaaatgagaagctgttctgcatccgtgttctgatagcaaaggtacctaatggtgatatgattgagcactttgaatgggtcagtttctgtgctaaacccttgacctgaattacctcatttaaccctcccaacactgggaggaggctacaattaagaaaagaccaggcacagagaagttaagtaacttgcctgagatcacacagttagcatgggacagagctgggctcaagcccaagtctgtctagttccagctctgaagctcaagtgttttttttttgttgtttgttattattttttttaagacagagtcttgctctgtcacccacgctggagtgcagtggcatgatcttagctcactgcaacctccacctcctggattcaagtgactctcctgactcagcctcccgagtagctgggattacaggagcacaccaccatgcccagctaattttttctttttttttttggagacagagttgctcttttggcccaggctggagtgcagtggcacagtctcagctctcagtaacctctgcctcccaggttcaagcgattctcctacctcagcctcccaagtagctgggattacaggcaccctccactaatttttgtatttttagtagagatggggtttcgccatgttggccaggctggtcttgatctcctgacctcgcgatctgcctgcctcagcctcccaaaatgctgggattacaggcgtgagccactgcgcccggccaatttttgtgtttttagtagagatgggtttcgccatgttgcccaggctggtgttgaactcctgggctcaagtgattcacctgccttggcctcccaaagtgctgggattacaggcgtgagccgctgtgcccggccactgaagcccacactcctaatccctgctgcatacagcctccctgccatgaggaaggattggagctttggtagttttcaacaggctgaaggtttgtaacagttgaagattgggactttttaatttccatgttgcgtattctataaacaggaaaatgacaatgactagacctgtccttttcaggaagaaaacgaggtggtcagtttttagagtaggaggcattaaggctggcagagaacctcctcaacccatcaagtggggaaggtggttcatgatgccaggagaacataggtctctgagtttaggttttgtaaactagagtgtgttttcctctccctgggaaagatagagccagatagatgtttctggtacctggagcagagggatctgtgagaatcttttggtgggtgaatgaaggaactttgaatgccacatgaagggtcccacttaaccccagaggttggggccaggctgcagtagagcacggtcgaacctcagtgttcgctccatgcagctttatctgccttcactgaggtggtctgaggaccaccctgcatcttcaggaatgtctctggaaggagccaggatacgaggctccttgaccagagtataggcacaggaagccagggttacttggtaaatggtagggcctaatcctggctttgcagcctgaagcgctggttctgggataggttttatccagcagctctctgaccacacagaatcactcagtgtgtctgatacataaaagatgctcagtaaatactgtaggggcctattatgtgcacctttgctcattcagctacatgctttgaggagaaataaagggcagggggaagggagcggtagataggaagaaaagtagttcaggtgattctgtctgcctttccactcagcaagtatttgtccctgggtggctgtgcctggggtttgtgaatctgccagccccttccttgactcttgtttctatatacctttcaaagtgtgggcattctgccacactgaatgaggtacagtgtttaaaaacaaatggtttggccatgcgcggtggctcatgcctgtaatcccagtgttttgggaggtcaaggctggaggattccttgaggccaggagtttgagaccagcctgggcaacatagcgagatcccatctctacaaaaagttaaaaaattagccgggtgtggtggcatgtgcctgtagttccagctactcagcaggctgaggcaggaggattacttgagcccaggagttggaggctgtagtaagctatgatcatgccagtgcactccagcttgggtgacagggcaagaccctgtttctaaaaaataaataaaaacacaattacgtatagcatggcttgaatacaagctggctgcttaccaggtgctcaggcgagcttcaccaaaattggaggaaatactgttttgaaccttttgagaacccatatgtttgtttcctaagcaagtttttggataatcttgaattatacaggatattttccctacatacttgctgtagatccacccctccaccactgtatctgttgatgacgcattcagctttttgcctctgttgctgtgtgaactgggatttggctgggctgtggccgcctgcctggaagggctacatagcctcattttggcaatgtgcttatgaattggctgtccggctattcctggtttgttgaatgagagttcagaggcaaagctggtaccaccacgaggttccaattcctcagagtcacgtttcttaccagtgcctattctcttttgttccaaagaggccacttttgctatgacctcaccctcgggcatcctcttgataacctgagcgttagtagtggggatcattgcgttcccagagagccctgccaggaggagtagcagcttaggaatctgttgggggcccctggcatttacttggatgtatctgaatgaaggctttcctgttcttgcacaactttcctctgcattacagtagagcctgtgtggtgtgatcagtttctgttccaaatgctcatgtcagccccaagcagggcttctcaccctcagcactgttgaccttttgggttggataattctttgtcctgaggggctgtcttgtacattgtaggacgttgagtagcatccatggcccccattcactcgatgccaatagcatccctcacaccaggtagtcatgatattcagtgtctccagagtgggaaatagtgagttactgatgaatgggcacagagtttctgtttggggctatgaaaaagttttagaaacagatggtagtgatggttgtgaatgtaattattgccactgaattgtacacttaaaaattattaagatggcaaacttatctattttaccacaataaaaaaatgtctccagacattgctaaatgccctgtgggggcaaaatcgccctccagttgtgaaccactggcctagaagttctcactagtgcatcattatgggacattacccactggactgaagtgttgctactatttatcccttccttttgatttcatgtgtcaggttaaggattttagaatttagccatttctctttaaaaatattgtggtaaaaaatacgtagcaaaatttaccattttaaccatttgtaagtgtacagttcagtggcattaaatacattcacactgttgtgcagctgtcactagccgaatctccagagctgtttcagcttcccaaagtgaacctctgtacccattaaacactagctcttcataccctcctttcctggccccggcaaccaccattctactttctgtctgccatttctttctttctttttttttttttgagagtctcgctctgtcgccaggctggagtgcagtggcaccatctcagctcactgcaacttctgcctcccgggttcaagcgattcccctgcctcagcctcccaagtagctgggactacaggtgcccgctaccacgcccggctaatttttttgtattttagtagaaacagggtttcaccatgtcggccagcatggtctcaagctcctgacgtcgtgatctgccctcctcggcctcccaaagtgctgagattacaggcgtgagctaccatgcctggcctctgtctgccatttctttattcttttcccttagcgtctagcagacagtaatgaagctgcagaattcttctctgacttctttatggatagaaggtatgttacttcaggaaaaaagcaagcaaaacccaaaaatgtagtggatatattggcttaaaaaaatcttgaacccggtctctactaaaaatacaaaattagctggttgtggtggtacatgcctgtaatcctggctacttgggaggccgaggcaggagaatagcttgaacctgggaggtggaggttgtgatgagccaagatcgtgccattgcactccggcctgggcaacaagagtgaaactccgtctcaaaaaaaaaaaaaaaaaaaaattcttgatgcaaatgatataacctctggaagggaatttggcaatatctagcaaaatttcagttatatttacccattgatctaccacttccacttctctgtatcttgatatattggcaaaaatatgaatagttgtagacaataggccatgcgttgcaacactaattataatagcaaaacacaggaaagagttcaggtgttcgtcagtagaggatgagttcatcattgtgaatgaaccgattcgtctctgcagtggaacatcctgtagctctaagaaggaatgaggactagctctgatatgcggtatctagaatggtactgaccagtgtagtagccatatgaggctattaaaatttatatggattaaaattaaataaagattcagttctgtcatcttggaaggttctattgggccacgctagtctagaacaatgtgtagtattccatgctaccttttacctatagggggatataagcacatatacatagttatatacataatacacatgtttatataaaacaaatatgtttatatacacctgtgtatacttgtttatattgaaaaaatggaagaatatacaaaaaactattggaaatattatctcaatggggaggagggacaaggatggaaactaagtatctttgaaagtaccttgttttgtaaattggattttggaactaggcaaatgttttacatacttataaaataaaaacaattcaaaatgataagccctcctccccctaccccctaacttcttggtgcttttccctcccctttgaaaagcccacctgcttgtgtacttcatgctggaatagtacagagtactgaatagtggtcagtccctccagagatcagtgaaaactttgctcctgccaccctctggtggccctgccagcactttcatctaatacttaaattgttttatttggttgcttgtttgtttgtttgagacaagttctcattctgttgcccaggctagagtgcagtggtgcaatcatgactcactgcagcctcgacctcccaggctcaagtaatcctcctgcctcagactcccgagtaactgggacttaaaggcacatgccaccacgcccagataattaaaaaaattttttctggagacaggatgtcaactgtgttgcccagagtggtctcaaactcctggcctcaagtgatcctcccaccttagcctcctaaagtattgggattacagatgtgagccaccgtgccgggcctaaattgttaatttgataatagcctctgaaacagagggagaacagtgcacacaagcaagtttaggtttcgctgtgggaatttacattcttttttgtttttaaaccccaaagatgtcaagatagttacttaaaggtttttgacaaaatcccaaggagattatttctgttctattaaaacatgtaatacatggagagaaaatatatcttttgcttttttagcaagagggtcctgagagagttaggagaggaagtgaagggtcaatggaggccatgtggtcagctgggagaatgcagcagccaggatgttattgaccacagcacaggctgacattgagtgggtgcagatctttggtggaattccaagcatgttgcacacctgacctcactttatgactctgggagggaagggagggaaactgaggtgcagtgagaaggggtgatcggtacgaacttcctccttcacacagaggaagaagagctagaatgagaactggaatgactggccctgaggggcctgttggggctgcacatgtgcctggtcagagcctagacctgcccattgagtgtgtatgaatcactgacttcgcagagctggaagggttccttgtttcaaggacaccgagactcagatggaatggcttgtccagggatagtgacggaatcgggactaagaatatgagtagctgccatttaagggctttccatatgccaggaactgccagcaaacactatgagataggtactgtcaatcatccgtggtgagcttgagcccatgcacttcatgggctacgccactgatcctttagtgtttgttctaagcttccagtcatgtgaaaaactgcccattaaacttggttggaatgatataaaatactgagtatagtactttttttagatggctccggagtcacagagacctgggttgaaattccagcccttgtacttgtttaagtttgtcaccttgaacaagctacctaacctctccaagctttggctttctcatctataaattggggatgacaggtaatggggttttgaaatttctagatagcacttttgagcttttgtgcaagaaggcaagcagaaaagagttcagttctatgtggcaagtaacataaacagggtctgtgaccttcccagagaccaagaaggccatcatgacgtctgctgttcaactacataggttcccaagtcccttggtacaaatcaggaggggacaggtagaaggactgagagaggtaggcttgtgatttgttacctgagatgatgatgtgagagtggacacacatgcagctgctccagatatggctggagaagtgcaggaacagtggggtcctggtcagcaggccggccattatgcccctgaccagctggatgcgtcctcctcacgtctcctgttgtaactgacttgcactgagttgcaaattgcaaatgggtgttgaccctggaagggactcttgaaagtcaccactctcacgactttctagtccttagagagtgggtgggctccatgcagcacagactgggagagtgccatgactgtgggcacttgatgtgcaagggctgcctgccttccagacatgccattgtccttcgcacattattgcctccaggagtgggagcagtggccaaatacacatcaggtgtatttctggacccacaggctgcagcaagagcaccggatacctaggagttgcatcctggcttggaaagcaggactcggccggttagtggatgagtccaggtcattgctcagctcagtgaagagagtgtcccttcagtctagccccaggtctacttcagctatgcagggattggttgcatgagggctgggacacaggaatgggggatggggatggggatttgaaggaagacttccctactgattgcttctacagtaggactatggacttttcctctgtaaaagacaagtacttttggctgggcatggtggctcatgcctgtaatctctgcactttgggaggccaaggtgggtggatcacttaagctcagaagttggagaccatcctgggcaacatggtgggattctgtgtctacaaaaattagccaggtgtggtggcgtgtgcctgtagtcccagctacttggaaggctgaggtgggaggattgcttgtgcttcagaggcggaggttgcagtgagccgagatcacaccactgcactccagcctgggcgacagggtgaaactgcatctccagaaacaaaaaaatagacgaatatttttaagagtcctgctttagtaagaaaggagtggatgctgggtgtaggggaagtcaggggaagaaaaaaacctccatcaaccctacgcaccctgatggtgttaaggactagtgttcaaatccaacgcacaggaaagggtgaggctttaaaaccaaacaatggaacaaatagcaaattaggtatttactcaccatataacaaaggtgttgcacaattgttttgttaagtggtgaatcaaaattcagcttggccgtgccttgtgctgtgggcccccaggcccatgcccctgcctccagcaggtctctaatccagcagctgggctgggtttttctgatctctgttccagtagcactgagggaacgtgtcctttggcccgtcacactctgttacccctggcttgtctcctgtctcattagactgcgttcttgaggacagggattgacactagatcctcagtgctcaacacctgcctgcctcgattgggtccacaatgaagatttgaaagaagagtgggaaatcagagaggcaagcaggtgtgtgcattttcctctttagctttctcctgtgagctctactctcatttgtacacctgcatattccaaacctctttttgaaggttttactgccacctcaaaatccgtttcgaagctcacccctcactcttgcttcttgtcttgtgtttcctgtttccttgtatctgaatatccctctccctgtcatcctcagcccatgtcgcccactgctcggctctcccatgatctccttccctcttctgcaaccctcattgcttctgccgtgctactgatttgtcttcatctggtctctagtcctcctaaacatttattgaagttgcttaacctaaagaatatccacgtgactgctgtgttgcaggtcctgtgttggaggaggtgggcccagatctctgacctataccaatctcttctggcatcagtttcttccatcctgttggattcttcacttcgaactcattactcttatacaggcaatgtggggaagattgaaactgattccttggttggcattcagggccttctgtgatcttgctcattcatccgtcttttccagtcatgtcccgtggctccctttcatgcatgctgtacgttccagccagactggtacataccccgtcatgccctacctcttcctctgttatcatgtggcttcctgcgggaatgccttctcctcccttcacttctcccatgcccttgtccaaattttgtccttgtgcttcagctcaaatgccatctcctccaggaagccttccctgctcttatctggtaagcatttgagtacctatagtgcccatagtccaccactggaggagacaccttgtttttgttttgttttgttttgttttgttttttgagatggagtcttgctctgttgcccaggctggagtgcagtggtgcgatctcggttcactgcaaccttcacctcccagggtcaagtgattcttgtacctcagccttcctagtagctgggatgacaggtgcatgccaccatgttcatctaattttttgtatttttagtagagatggggttttaccgtgttggccgggctgctctcaaactcctgacctcaggtaatccacccacctcggcctcccaaagcactgggattacaggcatgagccatcatgcccggcccccttagtttaattgcttaggctgtatatatcattttgcctctctgcatcctgtgtcctctccttgaggtaagttgggtctatgtcaaattcctcatagccatctttctgcctagtgcagtgtgcagcccacagcgtgctctgaggaggtgctggctgcataatagcacctgtttcctgccttgccctccctgtgctaagccctttccatgctttgtttcacttaatcctcacagcagccctttgacccagatgctattaattttgtcttcctgaggaggaaactgaggctcagagagattaagccacttgcccagggtcacacagctggtaggtggtagagctgggttctatgcccagaacttttgcctttaattcctgttgtatgacccgaatgagtgggatgaatagaactgtcaaaataggatgtgtaaagccagtggaggatgtaaacttcagaggatgccacaaattcagaaagaacgcttctcattttttaaatcactgtgttcagtgggtttcagccatgccctttaccaagaatagcccacagcttagaccatcattaaaaggggtggggtgggaaaggcagcaggagagtaactggtcttctcaaccccctcacagcaatgacttcccaggaactggtgtttcagggtctcacatcctagtagaccaggccctggagtgttggagaaagacagccaaattgcctttttgcctcttcattccttctttaatcccccaaatccttaaggagtcatgactgtcatatactgtcctaagtcctctgggaccacagaaatgactcaatcccattcaagagcctttgctgcaggagaaggagtgaaacccataaatgaataatcctaactttcagaaaaagagttaatgtgattctgagagacaggcttttactgtggaaatggggaggaaggagaaacccttatatctccagactacagaagagcccccaagcctcggcttccttagttaacacccccaacttctgactcagtttgtcaggacctgtttctaagcctggaggtttggacacccccactgccctgccaggagtttgctgaggaccttggttttaagcctgcaaaaggtgtgattagaggcattgtggcaggagcagcctgtctttaaaagagcgaggaaagctaggcggtgtctccctgtgttgaactgtctggacggctccagctctggactggtaaagtgaataaacgagcagatactaagggatcctttgtaccttgcactttatgtaacatagtcatttagttctcgatacaaccctattttgcagctaaggaaacagacatttgaaacagctgtaatttgcccaggaatgcatggctaaaaggtagctcttaattgtagtctgatgctaggtgtggaaaatcacttgggaggcatgaatggagccatgttgttggggagaagaaaggcctgttctgagcttaagggcagaatccttaggaaatatttccctgttctttgctgtgggcttgcactatggacggataccaaagaactgcagagagaaccttttactgaggagaggccagtgcagtggaagtcatttggttagaacctgcccaacagacagctgatcaggcctggctggtagaaagaacagaatgttaacaaatatggtatgcagtgttagggaggcagaagaagggagaatccatgggcctgcttcgattgctttcgagtcatgagttggtggtgaatgggacaggccttaaaaaagtcagagattatgattcaaaaccagacaataatttaaaaaatagatttcgagaatgctaccctccagaagggccctcagagagaatctgaggttttatttacttgtttaacggacagcaaactgaagcctggtggggaaagcaacaagccaaagatgacagtgtgttacccacagaaccagacagcttgctgatctgaataagcctgtaagacaggagtttagtggaggaatagaaggtgaatggagcaggttcataagagagcaaggcagtggattgatctgtatttttgagaaacctcccagcatggagttgggagtgttagctaggccaagtcaagatttctaggacacggggcccaagtgtctttggagatgcaaaagagtccatggtgaggggggcaccaacactgcagaagggggagggaaggataactgttggatagggatcatttcccagttctgagtggagtccagagtccagagagcgtgctgtaaggtggtgtcctataagcttatcatgtgctcttccctgtttcacctgtaggtgattgcagtggtcatggacgtgttcacagacatcgacatcttcagagacctgcaagaaatatgcaggaaacagggagttgctgtgtatatccttctggaccaggctctcctctctcaatttctggatatgtgcatggatctgaaagttcatcctgaacaggaaaaggtttgtggtacactatatccagtttcaccatagtcaacaaatatgaccaagcatccattatctacaagctggctggtggcggtatccctgtttacaaggaagggactgaggctgtgagcaaagtcatttgcctggtcttacagaaaacaaacagtacctgtgacctggcaattctcctaggtgtctacccaagagaaatgaaaatatgggcccccacaaaaatttatgtgtgagttttatagaagcattattcataaagccaaagagtggaaacaatccaatgccaatcaactgataagtggataaatgatatgttgtctattcatacaatagcatactattcacctataaaaaggaatgaagtgctgatacatgctacagcatggatgaacctgcaaacgtgctaagtgaaggaaaccggtcacaaaagaccacatatgatatgattccattaagtcagaatagggaaatctatagagacattgattagtggttgcctagggctggggagttgggggaaggacgggattattgctaaagggtactttattttagcactttctttttaaactgatgagaatgtcctaaaattgactaacggtgatgatggttgcatatatctgtggatatactaaaaactacagaatttgtgttaattgtatgatctgtgaattagatctcagttaagctctttaaaagaaatgttaggattcaagaccttggcctctcccctgtactgtcctgcctcttaatagagcctggaccagctcccttgttgaaggcctgaaggccaccctggaagttgctgcttttgacagtagctccaggaggctgcccttttaatcacagcaaccagtattttttgagcccccactctgtctttggcactgctccatgctttttttttttttttcctgagatagagtctcactctgttgcccaggctggagtacagtggcccaatctaggctcactgcaacatccctctcccaggttcaagagattatcctgcctcagcctcccagttagctgggattacaggtgcgtaccaccacacctggctaatttttgtatttttagtacagatggggttttgccatgttgtccaggctggtcttgaactcctacctcagatgatctgcctgcctcggcctcccaaagtgctgggattacaggcatgaggccccatgcccagcctgctctgtgcttttaacaaatgttatgtaactgaatcctcaaagcagcccctatcaggtaagtggcacctgtgttttagaccaggaaatagtgacacagagaatccaagtgtccaccacttcaaagtagtgggcctagggtctgcctccttgtatgtctgcctccaaccccagtgtctgtaatcactattacatgctgctgctgttcatttctcattattgtaaaattagattttatgtctatttctctgattctgaaaatgacctaagtgtttcagtggaagcctatacaacatagctagcttggtcactttcatggaaagaagaaagaaaaattgtcatatttattacagaatttgtttttttgttgttgttgtgtttttttgagatggaattttgctcttgttgcccaggctggagtgcagtggcacgatctcagctcactgcaacttctgcctcccgggttcaagcgattcttctgcctcagcctcctgagtagctgggattacaggtgcccaccaccacacccgactaattttttgtatttttaatagagacagggtttcaccatgttggtcaggctggtctcaaactcctgacctcaactgatccacccgcctcggcctcccaaattgctgggattacaggcataagccaccatatccggcccagaatttgttttttaaaaattaagcaacccatggcttctcagccttttggctaagatcaagtgtaaaaattaagcatcttaacctgtgagcttcagaactttatttgttcatcacctgtatgagtatctattatgcactgggtactagatataaagcagtcagcaaaacgaatttagtctttggtactataagttactgcctaagagactctaacttaccaccttattattaccaagcaatttggtttacagaattcagattctcccacagagttcttgttggttgcctcatgataaagacaggattggggtttctagaccaattgagatgagacagccatgtaacccaacaggtggttagaaaatgagtccaggtggacccaaggaagatacactttggcatggaaaagagcattatcagctagccaggtaaagaaatggaaggtatcagtgtttaatttcaaggtactctttctataattaaggctatgcattagcagagaaatcacagaattgttctggccacaactttggtcaagtgattttctctatttatctactagacagaaatctatgagcaggcaccggttcagttgcctactgttggttgttgccttcataggtgtccagatcctctgcaggggggtttaagaaggcctatttctggccgggcgcggtggcttacgcctgtaatcccagcactttgggaggccgaggcgggtggatcacgaggtcaggagatcgagaccaccctggctaacacggtgaaaccgcgtctctactaaaaatataaaaaattagccaggcctggtggcacacgcctgtagtcccagctacttgggaggctgaggaaggagaatcgcttgaacccgggaggcagaggttgcagtgagccgagatcgcgccactgcactccagcctgggcaacagagagagactctgtctcaaaaaaaaaaaaaaaggcctatttctctggcctccccagtttttgtagttttacctccttcctggggaagcactgtcttccctggttgcttgtgtctcctgttcctctctgtgctagtgaatttgtgccccttgctgtatgggggctgatgtccccatgctctgcctctgtagctggttcagaatgttgggttgtgctgtctgtaggaacttggtcacacattgatgtgcaggcgctcacaagtgctttggccacgatcacagaggcatatgcaacattcagatgtgtgtcaaagggaaagatacagaaaaccacacctaatctgcccataatggtattcttatgcttattatatgttgatcctttaagacttggctcaggggtcatcacctcctccaggaagctctcctcccaccaagtccaggtgtacctctatgacattccctagtcgtttttctttttttaatttttattttgaaataatttaagatttataaagaagttacaaaaataatataagaaattcctgaatactcttcacccaagttctccacatgttaacatcttacaaacctcagtacaaataacaaaatcaggaaataaacttgatatcaatactatctaatttacagacttatacatttcccggtcgttccactaatgcccttttttatggtccaggatccaatccagtccaggatcacaccttacatttagttgtcaagtctccttcatgtgatttaatctggaacagtttctccatctttctttgtcttttagggtcttgacctgcccccaccccccccccaccaccccaccccccgtttttttttttaagagataaggtctcgctatgttgcctaggctggtcttgaactcctggactcaattgatcctcttgcatcaaccagcctcccaagtagctggaacgacagacatttggcactgcgcccggctggatcttgacacctttaaagaatactagctagctgggtgcagtggctcacgcctgtaatcccagcactttgggaggttgaggtgggcagatcacctgaggtcaggagtttgagaccagcttggccaatatggcgaaaccccgtctctactaaaaatacaaaacaattaaccaggcatgatggcaggtgcctgtagtcttagctactcgggaggctgaggcaggagaattgcttgaacctgggagatggaggttgcagtgagccgagattgtgctactgcactccagagtgagactccacctcaaaaaaaaaaaaaaaaaaaaaaacaattttttgtagaatttgggtttgtctgatgttttatcaaagttaaattcagattacgcatttggtaagaagaccacagaagtagcattatgtcttgccatagttttgtgttttatttttagcttattttgaatattgatagattaacagaagttgcaaagattgtacagaaaagtttcatgtacccttcacccagtttccccaaatgttacatcttatgtaacttatggtacaatgtcaaaacctggaaattgacattgtatacagctttgtgccatgttatcgtcatgcatgcatatccagacagaagtttccatcaccacaaagatctccctcctcctgctcctttatatagtcacatcactcccctcactttaacccctagcaaccactaatttgttctctatttctataattttgtcgtttacagtctattttgtaaatggaattatacagtatgtgacctttcaagatttgctttttttctctcatcacagtgcttttgaaatccatccaagatgtgcacgtatcaacagtttgttccttttcattgctgagtattgtatggtatcttataccattcagccactgaaggacatttggatatttccagtttttgtctgttatgaataaagttgctgtgaacatgtgtagaggttttgtgtggatataggttttcatttctctggatgctgttatgtgttactgtagtttctaaatcaattagttttctctctcttattctagtccttgaaggtaaggagcatgccttacatctctgttgtctcacggcttggcacatagtaggggctctctatgtttatggaatcaatgagtcaaacaaaaatcttacacgtttaatttaaatgtgtaagatttctaacgatatagagccactggtctgctccagagaatgcagattgttgtagtattttgtatgccattgtttatacatttatgtgtgtcattttacaggaataattatgcatacatgtgcagtatattgccccagcataccactaccagtgtacgtttttggtaattatgtatttgtaggagatgtgacattgcttgttaagccacatgtgatatgagtgtttctgcctcagcaggcctgtactagagaaggcctgtcctgtgttcctattctccatacccattatggtgttgagggtgagtgaggatggactgttactctaatgtgatgccattaaacaaacaagttggaggaagatcagcttaccttctttcagactttgctaaaatgttctttattactagcatgttttctttgatgattttatcccacacattttgcttcagaatcatttcttggattctgttgtttagtatcccaaaaaggttgagtgttcttttagaacacatacacgcatgaactaagggtctcaaaagtaaatataagaaaagaacagatgagaagatggaccaaatgtagaagtaacatcacttgaggcttgagaactgtctggctagtgtaccatgtatactgtcactaaatggtgaccctaagccacgcatatgccaataattatatctgggaattgtaaactaaggctttttgtcctaaccatttgctcagcagatgagtattgctgaattgttcatttatatttctcccactccctgccaacagttaatgacagttcggactatcacaggaaatatctactatgcaaggtcaggaactaagattattgggaaggttcacgaaaagttcacgttgattgatggcatccgcgtggcaacaggctcctacaggtaagtctctaacccgtccaaggcttattaatctaaactcttcagaagaagcatgtcatgtaaaggtaaaagccttttcctctcaatgggagcctgtatggccatgcattctgatatgcgtgcatctgtgtatagcagctggttatcaaagcctcctgttagaggcagtttgggtgggggtcacttcccctgtcctgtagtccatagattaaaatgcagaagttgaacttgtattgagacaacacagtcagcaagtcctagatttcaagccttggcccaggtctgcaggggacgaactgggggttaacagcaacacacagtctggaatcctggttccttagggatctggacccagcttgccctgctcacttgaaggtaggggcagttgcaggcatctccattagtgttgaaggcagagccagagctgtcagctttagactcaaatcctccacgttgcttcaagccttgtaatttagagctttagtctagaaaatactgattatgtttctgacccacctttgaagtgtcacattggcaatggcatcttaaggtagagagcaggaaggttgaagagagggtggggataatgagcggtttacatgaatctctagaatttgtgccatttgtacatatgtggctccaatggttgtatgttctgccgcctctgcggtagattgtctgatggtttgcatgaggtgtgtctgtagaattttaaaaagaaaaccccatttttgaagaaacacacaaccctgagtgataattacgtgtcagccctgggtaaaggtagaaatgtgaaggcttgtggaaaatgaggcagtaagatcaagaaaatcttgacacctttctttttcaacagtaccctcattgctcagaacaaaatttgaactttcttcaccaaagaggctgtgggaaaaaacaaattgaactctttttcttggaatttccttttgtaagaagtttattaaaaaaatttgtttttaacctaagtaggatttatctatattaaccaaacttagctacaaatggacttttgctgttctaaaatataaaaactaccctctccaaatgaaattgatgacgatgatagcttccatttgttgaggaggttttataatcttggtgttggataggtgctttatttacattatctcattgaaggctttcttttttttttttttcgtgatggagtcttgctctgttgctcaggctggagtgcagtggcgccatcttagctcatttcaacttctgcctctcagattcaagcgattcctgtgcctcagcctcccgagtagctgggactacaggcatgccaccatgactggctaatttttgtatttttagtagagatggtgtttcgccacgttggccaggatggtctcagactcctgacctcaggtgatccgctggcctcggcctaccaaagtgctggggttacaggtgtgagccactgcgcccggcccagcctcattgaaggctttcaaaagaatcttccttctcaggctttgaaggcagttttcagggggactttgcattagccatatcttggttacaggagacagagttgactgtgttctatgatctctgtttgaaacctacttctggtacaaataccaccattagtggggtgatggcaagtgtcagctaactctcaaacgtactgactcgaagaacccggaaggaagcatagaaaggtacagttggttttcagttcatcttgacgtaggagccacacgctgatcagaacactatatcctggttctgatgttttcgagttgacttttgttcttaggcaggctctccctttgaagtcaacgatcctggctttgtttattttttgtttttgagacaaagagtcttgcccaggccggaatgcagtggacgatctcggctcactgccaagttccgcctcctgcgtttacgtcattctcctgcctcagcctcccgagtagctgggactacaggcgcccgccaccacgcccagctaacttttttttgtatttttagtagagatggggtttcactatgttagccgggatggtctcaatctcctgaccttgtgatccggccaccttggcctcccaaagtgctgggatgataggcatgagccaccgtgcccagccagatcctggctttcttatatggcctttagtagctgtctcccaaagggtgaaactctttcactcagaattactatcaatcccttctgtcagaatccatttgataaagaaaaaagaaatctctgaaaacttacttggctctggtgggatcacatgcccaccctgaatgaatccctgcatccaagggaataggatactctggccagtgtggaccacatgcctgcccctattgtggttggagagagtatgataatgaaagctttctggggtacaggtgggtgtgagttctgctagcagaggagggaggcggggaagggacaccgtacaggcaagggcacatggccactaatcagctctaaaatgttttgagccatggtgttttgtgaaaatggcagcacagccccatgactgtgggtcctccactgttagtgaggaagactacttcagcagccacaaggacaagcttgagggcaggaaggccactgatgttgccactcaaacagtagcaaggagcagggcattagcaattcatagggcctagggtctgatctggagtccagcagtagctcccctctgtgataatccctttatctggtttccttacctttaagatgggggtgctggcctaaatagttttcttacctttaaaatggggatgctggcctaaatatttagaagccctattttttatttttaattaattttttgagatggagtctcgcccagtcatggaatctcgcccagtcatggaatgtgcagtggtgtgacctcagcttaccgcaacctctgcctccggggttcaaacaatcctcccacctcagcctcccgagtagctaggattacagtcatgcaccaccacgcctggctaattttttatgtgtttttactggagacagggtttcaccatgttggccaggttggtcttgaactcctgacctcaaaggatctgcccacttcatcctctcaaagtgctgggattacagtcatgagccaccgcgcctggccccctttccagtttttaaaaactctgaggcaaggaccaggtgaggtggctcacacctgtaatcctagcactttggaaggatgaggtgggaggactgcctgagccgaggagttcaagaccagcctgagcaacatagcaagaccccgtctcaaaacaaacaaacaaacaaaaaaaccctctgaggctgagcatttagtgtgtttgttaaacagttggcctttttacttttatggtaacacacataaatgttatatatgtgttaaggctagttaaatacatgcaaatggtaggtatgatatcaccaaatttgtgacccttatgtggtaagatacctgtactatattattcagatggacagtgagtaaaacaaaattgctcatccttaccagctgctgtttgtttctttttaatctttaagttttacatggacggatggcaaattaaacagcagtaacttggtaattctgtctggccaagtggttgaacactttgatctggagttccgaatcctgtatgcccagtccaagcccatcagccccaaactcctgtctcacttccagagcagcaacaagtttgatcacctcaccaaccgaaaaccacagtccaaggagctcaccctgggcaacctgctgcggatgcggctggctaggctgtcaagtactcccaggaaggcggacctggacccagagatgcccgcagagggcaaggcagagcgcaagccccatgactgtgagtcctctactgttagtgaggaagactacttcagcagccacagggacgagctccagagcagaaaggccattgacgctgccactcaaacagagccaggagaggagatgccagggctgagtgtgagtgaggtgggaacacaaaccagcatcaccacagcatgtgctggtacccagactgcagtcatcaccaggatagcaagctctcaaaccacgatttggtccagatcgaccactactcagactgacatggatgagaacattctctttcctcgaggaactcaatctacagaagggtcaccagtctcaaaaatgtctgtatcgagatcttccagtttgaagtcttcctcctctgtgtcttcccaaggctctgtggcaagctccactggttctcccgcttccatcagaaccactgacttccacaatcctggctatcccaagtacctgggcaccccccacctggaactgtacttgagtgactcacttagaaacttgaacaaagagcggcaattccacttcgctggtatcaggtcccggctcaaccacatgctggctatgctgtcaaggagaacactctttactgaaaaccaccttggccttcattctggcaatttcagcagagttaatttgcttgctgttagagatgtagcactttatccttcctatcagtaactgctccgtgttcagactcctggtttcttccaggcttacagtggacatcatcagcttcctgctttaaaaaatatcttatgtccctaattgcctttcttttacctgactttgtcacctttgttgtctttgaattctttaggctgcatattattttacatgctttgttttgtcatgtatataccaggtattggttttatggtttaaacactatggatacaggggtttgttttgcacaattttaatagtcatgcactacataatgatgttttggtcaatgacagaccacgtatatgttggcagtctcataagattataatactgtatttttactataccttttctgtgtttagatacaaataccattatgttacagttgcctacagtattcagtgcagtaacatgatgtacaggtttgtagcctgttttgcatttttcttaggttgtatgctcttctgttttaaaggtttgaatcaccagcatttttgtgatcaaaatcctatttagaaaaaataaaactactttctgtttatctctttagaatatctgtgttcttagcattaaataaatataaacttgtgcttctgtactttttccccccctctgacacttttctctttaaatctgggagtatgtcacaaattaatgcacctaatagatataggtatatagatatctatatctgaaggttttttaaatagtgtcagggtgaggaagaagtagatgatccaaactatagaagagaaaatagatccacttaaccttcctcagcatcatgaatattgatgttactctatagtttaagtgaggaaactggccagaaatagcaggcctttgcacatgctctgccttttctcttttcgaagaaaaagcctgagctatttcagtaggtccttggtactctggtactctgcttgtctaccaaaggaggcgttagtgtatgttcctatattcattcccaatattaactctggtggccccatgggcctcatttcatcagctgggtgtattgacagtgatttagccatctaatatcccagagtaggggcaaaagaggacactgacaattatcccagtttcctggtccagtggcaggcagtgtaatggtttctacatccttctaatcaggattggtatggctgtggaatcctgtttttgtctcattctcatggacagacaaaagggaagagagttaaatgatgccttcctccctctcctgacttagctacagcaaaaaagatctataacaggggaaggtgtctgccacataaaatgctgatgcacttgtatcatgagtgtccctacactcacgcgtgtgccaggacttccttatgatggtcaggctatttgctgggttagtgctgtaatctgtggctataaagaaaaggaaaggaaggaaattgatccatgtctgcttagaaacaactctgagctaagcctcgagtaaacatattgttatttgaaatcatcttacagacttaagtcacttcatatatgccatctttgatctttgcagcaatgtagcagagagctatgcaggttaggtagctgttatttccaattttcagatgaaactgaggcactgattaagtagcatattcaagatgacatggcttgtaaatggtgatgcaagaatttaaacacaggtttctagattctaagtgcagtactctgttacatgactatttctctacacggagtatggaagcaggagagagtgtaccttgagaaatggcagttactgcaatggtgaatggaaaactaaaacagcctcattaacaaacgttaagtacaggctgggcgcggtggttcacgcctgtaatcccagcactttgggaggctgaggtgggcggatcacctgaggtcagcagtttgagaccagcctcaacatggagaaaccctgtctctattaaaaatacaaaattagctgggtgtggtggtgcatgcccctaatcctagctactcgggaggctgaggcaggagaattgcttgaacctgggaggcggaggttgtggtgagccgagatcacgctattgcactccagcctgggcaacaagagccaaactctgtctcaaaaaaaacaaaacaaaaacaaaacagcaaaaaaagcaaagtacaacaaaaaaaagtaagtacaaagtcctaatctgtgatacttctttttgtttgtttttgaagcagtctcgttctattgctcaggctggagtgcagtggcacaatcacagctcactatttttttgtaaaggcagggtctcactatggtgcctaggctgctcttaaactcctgggctcaagtgatcctcttgcctcagcccctcaaagtgccgggattacaggcatgagctactgcattcagcctgtgataatgtattttaatttagtttgaaattttaactgaatgttctatggaactgttaataggatgacataacaaaggttctgtgtttagtgtgagaaactgggccaaagaaatgtaaacaaagttctttaatgcaggactactcagaactctgaagtaatgatcacagtgaatttctcagagcagggcaggtatatggcttaccacaaactacctaccacagagtgctctttttgtggagcaggactcaaaaccattattctctgaaagtgtggccaacaattagaaataagagcaagagccgggcgcggtggctcacgcctgtaatcccagcactttgggaggccgaggcgggcggatcacgaggtcaggagatcgagaccatcctggctaacacggtgaaaccccgtctctactaaaaaaatacaaaaaattagccgggcgtggtggtgggcgcctgtagtcccagctactcgggaggctgaggcaggagaatggcatgaacccaagaggcggagcttgcagtgagccgggatagcgccactgcagtccagcttgggcgaaagagtgagactccgtctcaaaaaaaaaaaaaaaaaaaaaaaaaaagaagaagaagaaaaaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaagacaaaaaaaaaagaaataagagcaagagatacatggagtcctaagaaaatgacccagtctctcaaagtaagcagtctttctggagttgagtccagaaagtatcatttatatggcagagtttttcaaagtgagatctgaggaccacctgcatcagtcttggggtgcttgggtgcttccatttaaaatgctgattactggtttcactcccaggggagcggggtatgagtgtggcagcctatgtagttcaaaaatatttgttattcctccctgggagaaaattatatccctctgtctactgtcagatttggccatcgcagacttagctgtgaatatttcagcatatatatctaaaagataactgttttagaaaacataatcatggccaggcgcggtggctcatgcctataatcccagcactttgggaggccaaggcgggtggatcacgaggtcaggagtttgacaccagcctggccaacatagtgaaaccccgtctctactaaaaatacaaaaattagccgggcatggtggtgtgcgcctgtagtcccagctattcgggaggctgaggcaggagaatggcgtgaacccgggaggtggaggttgtggtgagccaagattgcgccactgcactccatcctgggtgacagtgagactctgtttcaaaacaacaacaaaaaagaaaaccactttaccactgtcacacctaaacaactttgatacaaacttatcaaataaatattcagtgtttaaattcagttgtctaatttttttctccccctgatggtttgtttgaattagaggttgatccatgcaggcttgacattctcctattaaaggaatcaactgaagaggtggccggccaccccacctctgtaggcagttgggctggggagtatctgtcgtttacttatgggacttaaagcgactaacaagaaaagctagggtacaaggtcgtgtaaatgaaaagttacatgaaggaaacccaagggtgagggataaaaagtggagtctggaatgaggcttgaagagcccgccatgacatacacacctacttcatgaggccacacgtttaagctttccaatagtgaatacagagaagcctggtcagatacaccattcgcagtgtccttaagattaaagtaaatccagatacagaaaggacagttattccccacggtggcatatgcctgttgtcctaggtatttggagggctgaggcgggagggtggcttgagccagaaaggacgaggctgtagtaagctgtgattgcaccactgccctccagcctgggtgatagagtgagaccctatctcaaaaacaacaaaattattccaggcactaagataatttctttcaaggatctttttataaaaacgatacttataaaaatgacattctggtaatcacattccgataataaacaatgacagatactctggggcatgcccggaccctgaactctgcagaggcagttgtctgaagcagtaaatgaggtgaatgtattcaggtgtattctgtgagcatggaatacataccttatgttgaatatgtttagatctacattgttaggctaagtttacacacacacctagatgtatgccccagtttgcctggcagagttccagttgatgcctcttatccccaagtcccatctggttaacacctccttttattctcaaaagtgtcccagtttgaactataaagtatataggcatcctatatagaaagcacctcgcagacctaaggaggctgtccccagttcacccaacttcattgaattgtgtgtccctcaggccaaagaaacagaggctcctctggctgcggaatcctttccagtggatctttccacaactgtacccaaatctttgaagctgcgtcagcacttttgcttatgctaataactgtgtgaacgtgatcatttgtgtgcaaaccaacaaaccagacaggtttacatatgttacagcaagttgtggaagactgcaccttagactcttgggaaaatcctgatataatgcaatttagtacagcaattctgtaaaggaccaccacttttcagtctggggatggctgcctgttgtctagcttgatggtggcaaccaaagggcagttagcgtttctcttaggaagctaacagttgtagcgggttgatacatggatggttgtaatggacatctattatttttgcttcattcattcaatcattcatcctctggtaatctcacgctcagatttccctctgaggaaccgttctgttcccagctttcagtccatgtgtttctgctgaagctgacctaacccgaccctggatgtggaacatgggaccaaggcctaagtccattagtacattagattcctgggcttagtggttgatttagggatggatacatggcctgtcaggaatacgttgccaaggaattttggaaagaggtttaatgcttaagaggatgtggtggctaaaactggcatggccactttgttaccacgttacgcctgaatcagcagaacgtggatcaatatgatcagaaagaatcctggttatgtggtatgtatcctgatgcagctgtgtctcaagtcagaactactcttggacttttcattttatttttatttatttattttttttggaggcagagtttcactcttgtcacccaggctggagagcaatggtgtgatctcagcttactgcaacttctgactcccaggttcaagcgattctccagcctcagcctcctgagtagctgggattacaggtgtgcaccaccatgcctggcaaatttttttggtattattagtagagacgggctttcaccatgttggccaggatggtctcaaactcctgacctcaggtgatccacccccctcagcctcccaaagtgctgggattataggtgtgagccactgtgcccagccagactttttagtttatatgagccatttctgcttaagagaggttgggttgggttttctatcacttatatccataaaagtcttaactggtacaaaaatgaaaaccctaaattctatgccttcctgaacatggtcaataggtttagtctggaaattcaaagcaaaaaataccctttatcataggcacagaaaaacttccatattgtaacacgattttgaggaacattatctttctggaaagcttatcatttggaagttgcaaaatacacctttatgtaacaaaatgattagacttttatggaattgttggcaatcaactaaataaattctggatgccatctcaagaaatatcagttttaatttcagagcagttattttagcccattctttctgaaaatagttaattaggaagactaagaatctgttgagaccattcctagtttgtggaaataaaaccacaacatcaacatgcaggttattacttaggtattttctctaacagtagtctgtgtaggcaaaataaccccttggggagagttggactttgagaactttctaaggcagatgaactaattttcttccaggagagtgtagctctaatgattttaagtggcccatgtagttgagcaaacactggcctgggaattagaaagcccgagttctagttttagttctgatactaaattaactcattgattctgaccaagtccttttaacttctatgtacctcagtttcctataagacaagaaattcaggctaggtgttaagtatggtctcctccagctttaagattatgatccatgagaccagcctgaccaacatggggaaactgtctctactaaaaatacaaaaattagccgggcatggtggcgtgtgcctgtagtcccagctactagggaggctgaggcaggagaatcgcttgagcccggtgggtggaggttgcagtgagatgagatctcgccattgcttgccagcctgggcgacagagcaagactccatctaaaaaagaaaaaagattatgatccaataatacaggcatggccgatttactgtctcttcataaacaggaaggtttcattatatgagtaatagataaaatagataagttattttatttatttttttttctattttttgagatagagtctcactctgtcgcccaggctggagtgcagtggcggatctctgctcattgcaacctctgccttccgggttcaagggattctcctgcctcaccttcccaactggctgggattacaggtgactactaccacacccggctaatttttttgtatttttagtagagacagaatttcgccatgttggccaggctggtctcgaactcttacctcagttgatctgcctgcctcagtctcccaaagtgctgggattacaggtgtgagccaccgtgccaggccatgaaataatcttaaaagtggcatttatttcattttgccttatattcatgtataaaccttggtttccgtatttgggctgttagtaaaataagacaaaaataaaacaaggaaaaatcaatgtcatgaagaactaaaactaagcctaaagcatgatgtttatctgtatattactcaataggcactgctactgggctacgaatgtgaatgtgccatggtcctcgtcctcagtaagttccctgtgtaatagtggcggcaggtaaaccacagatcaactaaaactaagcctaaagcatgatgtttatctatacattactcaataggcactgttattgggctacgaatgtgaatgtgaatgtgaatgctgacatggtccttgtcttcagtaagttccctgtgtaatagtggcggcaggtaaactacagatcaactaaaactaagcctaaagcatgatgtttatctacactcaataggcacttgttactgggctacgaatgtgaatgtgacatggtcctcgtcctcagtaagttccctgtgtaatagtggcggcaggtaaactacagatcaactaaaactaagcctaaagcatgatgtttatctacactcaataggcacttgttactgggccacgaatgtgaatgtgacatggtcctcgtcctcagtaagttccctgtgtaatagtggcggcaggtaaactacaggcaactaaactacaggtcacttttctcacaaaagtgagaatacagttcctagactacaagggggaatgtttaagttggatagataatttagagctagccctttaagggataaagataatttaaaggatggatggagaattctaggccgagggactaacagatattgagtccctacattaattactataaaaataaatcaaagaagattcttacatgaacctatgcaggtaaattcagatttttttccccctggtggatttgctctgagttgaggtaatgagagctaacattgattcagtgcctgctatgttttgcactgttaggtactttacatgttatctcatgtaatacctctttaaacctcattttacaactaaaattaaatgacagctaggagctaggaaatggcaaagttacgattccaagtctggactggttgtccacaaaagcccctgctcttgccataatgatgccacttctttcaaagaattcagaattttcttcacagctttaaaaatgcatagattctgaagcctctcacttccttccaattagttgcctacctagaaagttatttcctccacttgagctcatcaccccttcttagcgctcctttggattactgtaatttctttttctttgacctcacctttcgtctgatggattagtgtaatctttcccaaatttgttaatctgaagaattcaggagcttctcaaaatgcaggttcccaagccatgctccaggacatcgattcagaattggatcaaggcctagaatctgtgtttttaacaagcatttgactcaagggtatcaaattggaggaagcactgagttggtggactaccttaattgatctacccattttcagtctcttctgccaacccattcgctccaccccacccccagtccgtttttccgttttgccctcaaggtccctgaagacttccatatcatttcgcattgttttatttggggcactgtgccgcactacctgggcccacagcaggcgcgcaatatttactgacaaatacaacccacgaggtagttcctattattacccttcaatttgaaattgagaataaaacagaagtcgacaagttgaggtagcttgtgacatcagtatttcgtatttaatccagaaagcactgcttcaacgcccagtgcgtgcaaggttccactctcgggccagcggtcctctcccaaagcccgttcttcctaagtgtgcggccgccatccaggacacgccacgctcgtaaaaggtcacctgaagcatctaccctccacgctcaagaggtaggcggaggagcgcgcccttttctccaaaatggctgagcagggtcacgtgggctcgggggcggggccggtgcgctcgccggagcctggaagtgggtcacgtggctcagacgggggcggtagctgtgggggcgtggccgtcacacggcgcgatccgtctgggcagcggctcttcgggggccacgccctccgggccctgggggcctagcgcgcgacggtggggtggagctagcctcgtgaccttttaccccaacatggctgcgcccgtgggaccggtgaagttctggcgacccggtaaggcccttggtggaacgctgggcagatgcggcggcctgacttcggtcttggcgccgcggccggcgccctggggccagcagacctgctcgcaggcctgacctcggcgagctgggcgctgccgcctctgtgcggggggagctctggctcaggctccccagtggtcccgagggatttgggggtgctcccctagcgtgagcagaaactctttgtgaccttgttaaagtggtccagcctcctcaggcctcgtcttcctcgttactgatgcttgtcctgcccaccccgcgagatggggaatcctaaagctccctctcgtgtctcgttagcgccctggggttgcgctgtggcccgacagacaatgctgctcgctgctggaggcttgcaagcccaagttatggagtcagactgtccgggttcgaattttcgtctctgccttgtagtagggtgaccttgggcgagtcacttaatgcctctgagccatgacttctttacctgtaaagtgggcagaacaatagcttctatgctgtgggcttaaatgacaagcagaacgcgttgtcagacttagaataaatgctcaaaaaaagggaaagtgtgttattttcttttaggataattgttgtccactccgaatgtctactagaaaagggaacagtccttcatattggctgccagccacttcctctcttacagactaacacgaatcacaatcacaaaatgctttacttgttttgtcttgatatttactcattaatcaggtttttactgaatgtgcatatgccagaccgtactagatgcattacttcctctctgcaaacagtttcttgtaaaaaacaaaagtttttaaattacagctaccagcttgatttttttctaccacctgcacccctgcaggtctggatgtgcaaagtatattgcagcaaaaatgaaatgacaccaagaatgtaatataagcaaagcttttaatttttcagtggttctctgaaattctgaccatgcatataagtgatgtgagagataaacccaagcaagagatatgtttaatgctttttaaaaatttgtagtctgtcacttgacagttttatggttcagcatttcaagtcatcagccaattatccatcctgagttttatttgcatccaaaactaggaacttactaagtaatgaatacttttaatttattcacgcttttagtaacaggtgaaagtgttaggtataataaagagctgaattaattgtttgaaatcagaccagggtactattttggttaaagaacgtggaattactcttaagagttctatttcattatttagttcatccattgagggtacacttattgaaaacctaatcctgtgttcaggagacaaatacagatgctcagggctctgctctcaagttactgtctctctcttaattgaatataaagttagatgtcctctagaagagattttacaatgagacagagtaaggtggtggtaaagaagatgagctctagagtcagactgcagtgcccatcatgtctaccacttactaagttgatgacttgatagtcacttaaattctcaaagtctcagttactccatctgtaaattgggtataatacctaccctacccaaagtagtgttgtgaggtttaaatgagaataacacacaacaggatcttggcactagataggttactattataattatatggaagtatggaagagggagggaaagttgaatgtatggataagaaatacttcattaaggtggtatttttggagtgaacattaaaggatgaataaggttttgtttcatagagaaatggaactcgaagcaaagggtgcagcatgaacaaaggcagaatgggatttgtgcctttagaatgtccagaaagccaaaataacagagcagtgtgatagtgttaagtgctagggtatattttggggtatgacaggagatgaagctagaaaagtaggtaagggcctcattgtgaaaggtcttcatgacaagttaaaaagtttagacttcactgtttttttgttttctttcttttttttttttgagatggagtctggctcagccgcccaggctggagtgcagtggcgcaatctcggctcactggaacttccacctcccaggttcaagcgattctcctgcctcagcctcctgagtagctgggactacaggtgtgtgccaccacacctagctaatttttgtatttttagtagagatggagtttcagcatggtggccaggatgatctcaatcttttgatcccgtgatctgcccacctcggcctcccaaagtgttgggattacaggcgtgagccactgggcctggcctgacttcagtgtttttaagcaggaacaaatcaggtttactttagaaagataacactggcagtggagtagagagtggatggaggaggaaattagagaaggtactagtgaaatccaggagggatgttaaaaaccttaattctgacctgggagcttagaggaggtgcctgttggagagacattttagaggaagatgtgggagaagatgaagtcagtaataactcagatttctgggctgggtgactgtctaggttagtgattctctaattttgctttatagttgaatcacttgggaagctctgaaaagtcctgatgtgcacttgcacctcacaccaataaattagaactttggaggcctaggagccaggcatcagtgttttttaaagtctctaaggaattccagcatgcatcaaaatttgggaaccactggtctaggtaaattgtgttgtcattagttgacatgggaatagctttagtacacagttattgggccgttgctttgtgttagtcactttcatttacacatcttattaaacagtcacagtatctctgtgatgacagtaatactcttattttagtgaggaaattcaagatatgaagtaggttgtgggaaatgcaaggtgaaagtcagggaagctgatataaggctagacattcaaatcatgaacatatcctgtaggcctgagcctgtgattacagaggtctttcagacagtctaagtgagtgaagttgcttactggaggtaatagggagtggtggggactgtggcagagtgtgcatacactggatagtatgtacagtggagatctacagtagagcttacatatgctttctaaaatagggagttgtactcaggtccacctaattgttatcatatgggttcagagttgcccaattttttttttaagaagcctaatatccagatctgaatgggaaaattttatgtgttgttttaaatgaatgatttaaaacattttaacaatagcatgtctgggtaccttaagatacccatttgtggtgtctaccttaggagtgtgacttaagggccttgtatgacctgcctgagagttttctacaaaaatcttttacttaatttgcaagtacacgtggatccgaagggcctgcccattttcgtttgctcatttgataaatatttcatgattgttgaccatgtgcatgacgaaaactttacaataggttttaagctttttttgacttgacccacagtaagatatagcacacatacacaactgaagaaaaagttgttcataaacagtattgctttctggaatgtgctctgatgctttctattctatttcattatttaaaaagtgctggtatgacatactacattgatttcataacccactaatgggtcaccagtaaaatttttaaaaaccaagttaaagggaatgaggaattagggatatcagccttgttaagatagggaaatgaagatgttcatagtttgcaaaagttataaagttgttactcccttaagcatagagcgtacgctcaaggaaaaatcaatcataggcagccacagaggggtgtttatagagggaaagcagccctgatgttctggtttggttgaaggaagtcttttatgaggagaaggtatactgtttatcaactgacatagctgttcttataaaagagctcagctgggcgtggtggctcatgcctataatcctagcacttcgggaggtcgaggtgggtggatcaccagaggtcagaagttcgacaccagcctggctaacatggtgtgaccctgtctctactaaaaatacaaaatgagctgggtgcggtggtgcgtgcctgtaatcccagctactcgggatgcccaggcaggagagtcgcttgaacctggaaggcggaggttgcagtgagctggcatctcgccactgcactccagcctgagcaacagagactccatctccaaaaacaaaagctgataatagaagagatagattggggctgtaggttagagacaagggaggaatacggtagtacaaaagacatgttaaaatattccagagaggatatgaaggtttaaaacatgatttgaaaaggcaggaattcaggacaaaaacacagcagaaaaggataaggtattctttgtcattgttttcttgagtaacaattacaaggaattattaagatgtagtgacaagaagggaaggaaagaaagcctgtctctttgaggacaggcattgttccaggtcctgttccatcttttgtcttgttgaaaggaaggtcaacattttggcaaaagcaacatgacagtgccccacttacctgatttttggccatcttgaacctctgaaacacaactctgttcctggaagtaaatggaaaagggtcagagatctaaagcagtgattctaaacttagctctagggggtctacggacccccccgaattttatattctggtaaattctggtgtgttttttaggagagggagttcatagcctttatcagattgttgaagcaatctgagaaccctaaaaagtgtaaaagtaagtcactgagctgaatattcttgttacaaagctcctgtgctttcacttagcatcacagattctgagttcagaagacctaggagatgatggttattggttattatcactgtagtgccccagcaggaggctgtatagcatgtgtttgatctagggaggatttttattcatttacaaggcagcaaactccagtgctgaaaagtgtgaccttttggaaatatcttccttacattgagttgaattctgaaccctgtgtcatttacttattactcctagttctgtcctagagttacagcagcaaatcagcatgaaaagttatggaagctgctcacaaaatttaaagttatgtttctcctgagttgtttttctgtttgagctaaaactgtatggaaccttcaacaggttttcatgatgggatatggcttccctattcttcaccatcatgatcaccagtttgtcattgttattagcaagaagccggggtgaagatctcttgtttaatctgcccagcatggcggttactgagaatagcatttcccatctatccactcccgattccatggttccaatggggactgtcatttacctcatcccattccactggccatggttgattgtattggggtggggattggacctaagctgggagaagtcagtccctgtctgtccagtataaaagagcctcccccaccccccattacaacacatacctgggactcccagtcccccttacgttgtctttatttctctccatagcacttatgaccacttcatgcaccaagttactttccactgagaggaagaattaaaaaagcaagtgagctccgtgagggtagggctggcatctgtattgttcactgcagtgtttctagtgcttagagtggtacgtgacatggagtgggcccttggtccatccttgctggtccttgctggaccacgatgaatgattggtagaggagttgtaagcgtgaaccctggcactgccggcagccgtctttccagctcctgtacagtagccaacctaaggggctggaaggaacctgcaagacgtgccaagatgagagaaggagaaagccatggctgctttgagtgcccagtttctgtcatctctgagccttattgccatcctacagtaacaagattcatccttttacctcagctaattcccactgggtttctttcacttctgttaagaattcagtaataacatggacatggaggccagaagtaaagacactgtgctctgtaatacacagttctgagtggccaatttggagcccagtgggactgccatctcgtttcttttttctttttttttggagacagagtcttgctctgtcgcccaggctggagtgcaggggcccgatcttggctcactgcaacccctgcctcctggattcaagcaattctcctgcctcagcctcccgagtagctgggactacagacacacaccgccatgcacgcctggctaattttttgtattttagtacaggtggggtttcaccttgttgcccagactggtctctaacccctgagctcaggcaatccgcccgcctcggcctcccaaagtgctgggattacaggcgtgagccactgcacctaaccctgtcttgtttgtttttgacactgcagtgaagcttttagggaagatttttagttcctcgtaggcacttttctggattctttcctaaagttaaggttgaatacctttgagtagtttgagataaaaagtattgcttcttctgtatatcttcatctttgaaagtttataaacttaacacctttttctgttcattgtatcagagaatctgaaaaaaaaacatttctgctgcaggtacagaggggccaggtgtaagcatctctgaagagagacaaagtctggctgaaaactctgggacaacggttgtttacaacccttatgctgccctttccatagagcagcagaggcagaagctgccggtattcaaggtacgtcaaataatcatgttcaacctgtgggcttgaatcgtgtgtctgcattagctttatgctcagcactgaagggaatgatggcctctttctagaacacagtgagctcagagaaacccttactgtaagggatgacttttcatactgtgtattttttagttaaccttataaatcttgaaagtccttaagattttttcagttgcatcgtacatactggaaaactggaggaattagaatgacttttgttttcccctttattcctttcagctgtggacaatttcagatatacagaaaagtagagaaaatagcagttaatttctatataacagattaccaacatatggccaatttttgctttatttttaaagtcactcctttaaacaagtttaattgggaatatgaggttgtttctgctgaagacatcagttaatactctgacttcctctgagacagtgacaggattttggtatggttactacttaccaagtgcacatccagacactcagttttattagcgctcacgaaacagatgtgtgctcagctacaagagaccaaagtgcaaactagaattcattcagaactgttcatttatggctagcaataattctccagtacagatggacacagttgacatatacactttgtccctgttggcacatccacatgggaagccaaattgtaatcaggaagtacagagccaagacaggttacagaaatgtcatacagcccctgatgaggggtgaattctccctgctccacaggatgcccttggaatgacccgagtaggtgtggccaccagcatctgtgtctctttctttctcctggacggtgctgggtgaaagttgctgtgttctatctatctgtctgtctgtctgtctgtctgtctatctatcagacagggtcttcctatattgttcaggctggtcacgaacccctgagctcaagcagttctcctgcctcggcctcccaaagtgctgggattacaggtgtgagcagccaaaaggtgccaagttcttatactcatggagttcttttgactagactgtgctgataattcctcttctattaatgtgttctttctccaaacagataggcaacagcagccttcttaatttagccagattgccttacttggagttttatgtggctcccaatattttagtcacaagtgaactgactgtctctgggtttcttcctcaagtgactaacacattcactatgtatgaatgttagcaagtttgactttcaggagatgaaatgataggtttactattgctttctcaccactgagggacagtttgagctgtgatgaagtgtccggactctggagctagacttcagggttcaaacccaagcttcaccatttgtgtgctgtgtgacctcacttctccattctgagcttcttttctttatctgtgatgtaggactacaggagcacctacctcataggactgttatgaggaccagatgagatcatccatgcagagcatttagcaagatacctgacatgtagtaaatgctcaagtacaagggaaattactgtttactcaagtatttaaattttggccttttcttgactattctttgtctcccaactgtacttacaagataacataaatgaaacagcaaatgaaaaaaaaaaaagcaacaagaagttaagaaatgtttatgaaattaaaatggtaagaagaagggtgtaagttactgatataaagcaaagcagagtttaagtacagttgagatcttataagatgttgaagatgaatcgagacaaaaaggaaaacaagttacctctacgccatcctttttccctttcaaacaaaaagtaaaagtagctttaaaaacagaaattggaggctcggtgtggtggcttacggctgtaatcctataggctttgggaggctgaggcgggtggatcacttgagacaaggagttcgagaccaacctggcaaacatggtgaaaccccatctctactaaaaatataaaaaattagccgggcgtggtggcacatgtttgtaatcccagctacttgggaggctgaggcaggagaactcttgaacccgggaggtgggggttgcagtgagccaagattgcaccactgcactcctgcctgggcaacagagcgagactccatctcaaaaaacaaaacaaaacaaaacaatgttggaactaaagcatcaagagattgttaaagatcactgcctcttccccagcaccattatgaggccacctgttcccttgtctgccttctttaggctgctgtatagacaatagtgactctatcttggatgcaagtctgccatgttcacttctgtttagacccagtcttataaatgcctcctgatttctgctttgtatattgtccttagtgtaagaacatgtcaacctctctgggggcagcactattgacagcttcttgttttgttttgtttttccccaaaaacagtctacgcataaacaagtagatacgtgtttgccctaagaagaatgcagttactagggtattattcacactgttctacatctcacttccttttcttaacatatcttatagttcattccatatcagtacaagtagatatttcctcttcttaataactacaaattattccattattggaatattttatgactgatttaaccaaacttttgttgatcaacatttaggctgtttgaatttttggctattataaacaactctgcaatgagtatgcttgtatttatgtctttgtacacatatagtatgtagcagtatgtctataatttcttgttttttttgttttgttttgttttttttttttttttttttttgagacagagtctcaccctgttgctcaggctgaagtgcagtggcatggtctcgcctcactgcagcctccccccgcctgggttcaagcaattctgctgccttagcgtcctgagtagctagtattacaggcactttccactgcgcccagctaatttttgtatttttagtagagacagggtttcaccatgttggccaggctggtcttgaactcctgacctcatgatccacccccggccctggcctcccaaagtgctgggattgcaggcgtgagccacctcacccggcctataatttcttataagtgaaaatgtaaagggcgtatgcattatgtattttgataagtgttaacacgattgcagttgtattcgctcatactgagaggaacagtacctgagggttagaaatacattttgatagttctacttaaaattcactttcctttgaaaacagctcatttcacaatgtttaaatatcgttgtttaggtcttttgagacaatgtatggctatttgcaaggtgtgttattctttttcagcttaggaatcatattttatacttgatagaaaattatcagacagtggtgattgttggtgaaacaggatgtgggaagagcacacagattcctcaggtgagtacatatttaataagtgtctttacacttcgatttggctggaagaattttgtaacttgagagctctctttactatcatttacatttttaaggtctcctttcaggaaatgttcacttcaactagatattttttattaaacttttagggcttataatttctttggtgagtactaaagtaacagtttgtcttcgatttattataattccaaaatagtaatggaatggccatcttctgaaagttacaatggagatttattcaaagatgtgaaatatagagtttttatccttaaatagttacagttgaaggggtggggtaaaatgaattttgctgtagttgtaaataaaaattggctgttatagtattatgcagtgctatggaagaaccctttcttactaggaaaaatcctatgtgatgtggataggagtagaaagaaggatcaagaaaggccttgtaaaggaattggcatttgaaattgaccttgactgggagctgactgagaagatattccaagccagtgaatattgtggttagaaatactggggtggagaagtgtagggtgagttcagagtgtgtcttaagaaccttaacttgaagagtgaagactgactgagcttgagagaccttgcaggttcttacttccttttttaatgttaattttcttgaggtatgacatatatgtaggaaagtacctatatcataattgtacaccttgatacatttctgcaagtggaatacatctgtgttaccagcacccagatcaagaagcagaacattaccaaaacctcaagaactcttcttctgtgttctgttctcatctctaactgccatgtctgcttacccctacaatcatgaacacaagggtagctcttattctggctactaacctcataaattagttttgcgtatatttggaattttataaaggaataatatagctgcttttgtccaacgttatgtgtgagtcttccttggtgttgaattagttgcagtttgttcattctcattactgcatagcagggttcggcaagtcacagccagtgtgccagatgcagcccgctgcctgttttgtagagaaatctttgctggcacacagccactcctacttgttgatatattgccggtggctcctttcaggctaccacacagggttgaacagttttgacagagaccctacgatcctcaaaacctaaaaattaccatctggccctttacagaaatgtaaaatgtaatgctaacccctgctagttagtattccactctatgagtattctgtggtttgtttatttttcctgttgttactgacatttgagtcattcctagtttttagttatggatagtgctgctgtgaacattcatgtgcttgtctttggtgaacgtatgtgcacattctcctgctgggctctacctaagagtagcattgctggatcctgtgttcaactttagtaaataatgtctaagatattcaaagtggttgtgtccttgtagggtttgcaagcaagtaaacaatatgacaagctgagctttagataaatgattatattgagatataaggtgacttagaaactggaggaggcaggccatagaaagctattgcagtggtctagagaaggatggtgtaacggggtcctcaaccaagaggtgatagtgggataatctggtgaggatgggaaggagaacaatttacaattttagcgttagggtctgtagacattagaaacttaggttggtgcttttgcaccaatctaatagatggatatttgtgatgacaaaggggaagggacaaaggtgcacagtgactgatcacgacttgctgccttggcgaacagtgctagtattaaatgtgatagaaaagtaaagattgtttttttgaggggaaattaatgtgtgtgtttttaaacatatttattttttcctatattattgatggcctttgatgacattagcaggaagtttggaatgggaatctgaagcttggcagaggtcagacgtagaaggtgtggacatagggattgaacatcctgatacatgcaggaaggagatggaacagaaataactgagaagaggattaaggacaaagtccatggagcatcaacattcaggagtcaggagcagaaaggagatagaatggcagccagggaaatgacagaggaaccagcagactcttcatggttagagaaagcaaagacagagtgaggtttctggagaggtgggtaggtggcagtttcagccaacagagcggccagggagcaggagaactggttcagtcctgggttattcatcttggagatagcacgtccagtggtagggttttagggttaagggtgtctaagggtaagatgataaaaatccctttgcatatttgaatatgttaacaatgtgttgttgactgtttggtccagacttgtggtcatgccaggatctgtgtagatctttttttttgtctgctccccaactccattttgaataatgggtttataaataggttgggacccagatgtaggtatttttttaaagtttcccaatagacagctagggaaaggtagacagacctagtaaaggtagatgacctagtaaaggacaacttgaaatgcatgcagcagaggaaatggtggcctggaggaaaaagataaccgtatatgcagatggaattgagagcctagtaagttactcatttcttacaggaagaaacaggagaaaggttaaattactgtgtgattgtcatttagagagtaatataacaatagtataacaagtaataacagtaataagtgctacataaagtgattttacacatgttgatctgtttaatcctcaatgaccctatgaagcaaataccattattatcttcattttataggtgaggacactgtagagagtaatgaggttatggaatatagaacagaggtaaaagaccacatgatgttccagaattgtttgggaattagtctgtgacgttatgtagtcagcttaggataaactatgttctggtaacaaagaacctgaaaatctcagtggcttaaaaacacaaaggtttatttcttgctcatactgtgtggttatcttgggttggctttgagattctatcacatcatcattgggccttaggctgatggtactgctcttatgaggcacttgttgatcttgtggtagatggcagaatcatgagacagctcttaaaacttctgaccaaaagtgggccttctgttcacatttcattggtcaaagcaagttatatggccaggcctgatagcaacggggtgacagtgtatataatcctcccatagggatgggtggcaggtatttggaacaatgataaatatatcacagtgatttggccatttactcctgcaaggcttagctgccagggaacagagagggcctgctgtgttactaagtccagggaaagctggtgggaaggagaaagagcagaggctgaggatctaggctgggtaatgtgggcaaacaaaggtagtttttttttcttttaattttaagatttgaatatttttaatatttttgaacattaataggttcacatgatttaaaattcaaaaggcacaaagggacatacaaagatttccttctgccctgtcttcctggtacccatttcctttgtgcagttataatcagtattatgagtttcttggtagaaattttttcatgcatttacagagaagtgtctgtgtgtgtgtgtgtgtgtgtatgcacatatatgccctattttaaacatgaaacatctatacatgttttagtatgccttgacttttttttttttttttacttattctttcattttaaaaaaaaactgttttgaattgacacataactgtgcatatttatgggatttagtgtaatgttttgatatatgtatatgttgtataatgatcaaatctgggtcattatcatatccatcacctcaaacatttatcatttctttgtggtgagaaccttcaaaatctcccttagctattttgaagtctatggcacattattgttaactatagtcactctgctgtgcagtagaacaccagaacttattcctcctatataactataactctgtgcttgttgaccaaccttttattctccctactccctgttcccctcttccctctgcagcccctagtatccactgttctattctctacttttgtaagatcaacttttttagattccacatgtgagtgagctcatgcagtatttgtccttctgtgcttggcttatttcacttaatatcatgtcctctaggttcatctgtgttggcgcaaatgacaggatttcattcttttttatgactgaatagtattctattgtgtatatatatcacattttaaaaaccagttcatctgttgttggacacctaggctgattccatgtctcggctgttgtgaatagtgatgggagtgtacatgtctctttgatgttctggtttcctttcctgggaataaatacccagtagtgggattgctgcatcatatggtagttctgtttttaatttttcgagaaacctccatattgttgtccatagtggctgtactagtttacattgtcaccaacagtgtgcaagagttcccttttctccacattcttgtcaacatttgctgtcgttcatctttttgatagtagccattctatctggggtgaggtggtatctcattgtggttttgatttgcattttcctgatgattagtgatgttgagcattatttcgtatatatgaaataatacactgtgcatcttcttttgagaaatgtctattcaggtcttttgcccatcttttttttaactttattaaaatactgagttttatttcacatttattttacatatttttgtctccccaccatttccatgtctgaccaccactactattatgtcctatcatgacattccatacatacctaaaaccaagcaaagggtggagttccatctttaaaaatgaaacaggcattttggacaacgcagtcttggcaatggaacctggacaacatttatcaaacacggtagggaaagttctcactctgcattataaaaagaacagccagatatcaactgttgctgcttgcatttttgctttagtgttttctacagaacttttgatattttaggaatttttttcttgttttttgaaggattcttgtccttttgatcttggtgttggtggtattgagtcttttccattctgatttgacttttgtgcattttttggctggagtatcttgtatagctttctttactggggctttttcttcagtttcctcatcatcaaaatcatcatcattagcagcagcagcaagttttacttttttctctggaacgttgctaccacctccaggggcagatcaccttccagatatacttaagaatttcacatcttcttcctcttcatcttctgactctgcatcttcctctacagctactaagtgctgtccactaatatgcactggccctgagccacacttcaactgtaagaccaccggtggtattatttcaaagcccctaagggaaatcattggctgtacagacattttcaaagttgccagtgttactttaattggactgccttcgtaattcattgcctctgcttcaacaatgtgcaattcatcctttgcaccagcccctgagctgaccgttcttaaagataactggtgctcatcttcatcattatccaccttaaagtgatcatctttgatggcctttagttcacaaccaaaaagatagttctggggcctcacagggctcatgtccgtgtccatcacatctttcatggggtggtggcacgtacttaggtgggagagaaggcggatggagataaatgacccctgctccagagaacagctgtgcagggcggaatcacacccttttgctcattttaaattggatttttagttttttgctattgaattgtttgagcaccttatatattctagatattaactctttatcagataatagtttgcatttattttctcccattctgtaggttttctcttcactctgttgattgttttcattgctgaacagaagctttttaatttgatgcaatcccgtttgtctatttttgcgttttgttgcctatgtttttgaggtcatatccaaaaaatccttgcccagaccagtgtcatgaagtgtttcccttctcttttgttctggtagtttcataactttggtcctttcatttaagtcttttatccattttgatttgatttttatatgtggtgagagttagggaactggtttcatttttctgcgtgtgattatctagttttcccagcaccatttattaaatagattgtcctttccctaagatgtgttcttggtgcttttgttgaaaatcacttgactttaaatgtgtggatttacttctggattttctgttctgttccattggtctgtgtgtctgtttttatgtgaggaccatgctgttttgtttatagctttgtaacgttttttgaagtcaggtaatgccttcacacttggtcttttttttcacataatgtattgttggtttttttttccagttccatagatgctagtatgtgaacataatttaccaatccccaattgatagacatttaggttgtttacagttttgtattatcacaatgatgcagtggagtcagtttgcacataaatcattttgcacacatatagatatttttatagaataaataaaatacttatggggttgctggctcaaaacacatgtgcatttgaattgaattattttaaggaattgcattttattataaactttttaaaaataggaaatacatttacatagtacaaaattcaaaaagaacaaaggaataaatggtgaaaagttaatctcctaagctttgctgttgaaaatgactagatcattgtaatagattgtattattggtccaaatatctgctacccctcttatggagtattcccttttctcctagccactcagttccccgtacctgagacagtcactgtttccaacttattgtgaagctaaatttgggctatgatctaggaaaattggaatggctgaggaactaaaggttacagcaaggatacggagcaggtttttctctcttgttagatttatatagtacctttccttgggaaaaaacaatgtgcaaaagcactggatacttaataattttgaaattctacaaactatatgtagaacctagatgattttttttttttttactagagttctgtaaaaaaaaaaaacaaaaataagggctatgaacacaagctcttcttaagtacaatttttattagtactgttattggtggagttcttcctaattctgtcctttagccagaagcccagatttggtgatccttaaaaagagtggagaactcagatggacttcagctacgttttagtgatctccctccgtgactctccactgcctcttgacgttagcactacacctgctttttcagtagctttaaatttccacctctcagcaatcataagcatgccatagaagtctgaatcacacagggtattgaggtgactagctttatggacaggcttatttttatggaaattgtttttctttcacttaacactactgctaagagattggctatgtgtgtttgaagtaggataatatgttgtgttctgtttatgtgtcatgactttggtttgctgagcttgaagtccaggatacagatttttatttgtttccttggacaaattatgtggcctctttgtttcctcatctgtgtattgttgatgatgatgttaccttccttatagaatttgttttgaggattaaatgggtcaatgcatataaggcactcagtacagttcctggcacttaataaggtactcattgactcttagctattattcttatagttctgttttttttttttttgtatttgtgttgattggggtggttggtagtattttgtatatgtatttaatacaagataaactttatagtttttatagcaaaaaccctacattatcttcaaccctttgtttcttacagtcattttctaaactttatttttaactacttttagactaatagaaaaattgcaaaaaacaatacagaattcccttatactcttcactactagtgcagagatcgaaagcaggccattaacattggtacaataatagtaattagactataggccttatttaaatctcatcagttttcttactaaggttcttttttagttctaggatcctacattgcatttagttgttgtttctccctaatcttttctaggttgtgcgaattcctcaatatgtcttcatctttcatgaacttgacactttaaaagactaatgggatttactttgtagaatgttcctcagtttgggtttatgtcatgttttctcatgattagaaggagcttatgtatttttggcaagaatactacagaaatgatattgtatccttagtgcatcatttcaagggttcataatgttgatatgtcttgtcactggtaatagcaactttggtcacttggttaaggttccagcttttgcctgtgaaactactgtctttccctttttagttgatatgtatcttgggggacatattttcacactgcaaatagtctacttttcttccaactctcacctactaagtttagtatccccctcagtggatcttgtctgtagcagtgatgattttcttttctcctctttccctctatctttattaaatgtaattttctgtaaggaagaactgtgctttcttcctcacttatttcttagattatttgcgtgtatcaatatggattcatagatacttatttttttctatgtgttaaagcccaatactgtcattatttattgtgttgctcagattgtttcatctttgaacattagaagctccttcattttggctcctgttttctttctaaagctttcatttttttgaccgcttccttactttctagtactacaagatgtttcaggcttgtcttatattttttcctacacaagccctggttccttttattggagaatgatgtttagaaatcatgatctggggccgggcgtggtggctcacacctgtaatcccagcactttgggcggccaaagtgggtggatcacctgaggtcaggagtttgagaccagcctggccaacatggcaaaacctggtctctactaaaaatacaaaaaattagccgggcatggtgttgcatacttgtaatcccatctactagggaggctgaggcaggagaattgcttaaacccagaagtcggaggttgcagtgagccgagatcacgccattgcactccagcctgggcaacagagcgagactctgtctcaaaaaaaaaaaaaaaaaaaagaaatcatgatccggatgctagagtgctcattgctacgagatgtcattgctgagtctcagtgagcagacttaggaaatatatgtatgaatattaagccatacattataaaaacatctagctatctgtatctgtctatccatctatattttaaacaccatgagtttatgcaaatgcttctgattccaatctaataccatagggctcttttgagcctttctttatttataacttctctgcaacaatgagaagcttagtccttatcatctacagtatatttgtggattcattaaaatagtttcagaattgctaacttgtaaccttgtttggatatttactaactagattacagcatttatgtacagttctttctgtctttagccttacaacatacagtcaagatatatttttccatcattccttaggtaagttcttttcttctccaccccctgcagtgtggttatgttattcatttgtagtatagaaagggtcatctgttagtgtttatatttcctttaggtttccctccacatcctggttggttttatttgtcttctgggtgtttaaaaagtatgtgaaacatgcatggctgtgattctcagagtcagagctacacaaaaagatctattgagagcattgacacgccctctttatccctgttcccctccctccatttccccttctttctacacctttcccacccattccctgtagacaaccatttcttagtatctatattatccttcctttatttcttttgaacacatgagcaggtacacgcagtaacttttaaaatcttttttctattgtagaagtaatacatgttcattgtaaaactattagatgttagaaaaacatgtaactgataaccactgttatccgtattggattttaagtgcatataatcaaataaatacatagatattaaataagtaggtaactcagataaatacacttaatcaaattttttttttttttttttgagacagaatctctctctgtcacccaggctggagtgcagtggcaggatcttggctcactgcaacctccacctcccaggttcaagcgattctcctgcctcagcctcctgagtagtcacgattacaggcatgtgccaccacacccacctacgtttttatatttttggtagagacggggtttcaccatgttggccaggctggtcttgacgtcaagtgatctgcctacctcagcctcccaaagtgctgggattaccggcatgagccgccgtgcctgttcaatcaaattttatatatgtgtactaatctaatggtgtatagtcatatatataaaatccagttgttttatttaatatggctgaaatgtgttgtgtggttgatatttatgttgagccatctctatatgtgcttaaaaattctttgttctacagagttagcactgttttgagtgacctgtggataattttttgttccctgaggcatctgtagtacatggtgattttccaggactggggtgtcagaatgctggaattgcgccttagttcttctgttgatcagctttgatgtgaacttaagtaaatcacctaacattaccaagcctcagatcctccatctgtaaaataattcccaaagttctgctgggacaagaactgtactttttcctttcttagtgattttaacacaatacgggagcatcttgggggagattgctctgcaaaagtggtatcatatgtatacttagatgtgattttgtttgtagtaccttgcagaagccggctggacagctgaaggaagagtggtaggagtgacccagcctcgaagagtggctgctgttacagtgagtttctttttgtgttggaaagattctatctgtgttgtctacatttgtgatttgtttacatttcctaaaggctttaaatgaatagaagttgctccttaagagtttaggtcttcagtttttatgttttttttatttttatttttttcctcagacagagtctcactctgttgcccaggctggggtgcaatggagctatctcaactcactgcaacctccgcctcctgggttcaagcaattctcctgcctcagcctcccgagtagctgggattacaggcatgtgccactacgcctggctaatttttttatatttttagtagagacggggtttcaccatgttggccaggctgttctcaaactcctgatcttgtgatctgcctgcctcagcctcccaaaatgctgggattacaggcatgagccactgtgcctggccaggtcttctgttttaaaagaattatgatttgaatatttttgttaaattgatcctgcacattatgaacgttttaaacaataaagtgctgaggaaataaaaaaacaatatatttttaaaaccccaaatttcaccatccaacataaacaatgtgaacatttgtgaacatcattccaagcttctcctaaagatgaagatgaatggttgactggctggatagaaataattttataaaaatgagatcatatttaatatttattttttattgaatttaacaaaataggaaactttagtgaaataggagtagcgactgtactttggataaatgttcaccgcaagataatttattaaagcttgaaaagtaagaaaaaagagtacaaaaaaattcaagatgttacctatatttcaaattacgccttatagtttcctgttatgaaagaagaggaaattagcacatgtattcttctttccaccttccctttctccatttgttgtagatacagtcctgtcattttcatttcaagatttataatatacatgttcttaatcataattctcacaggtgtttaaccttaattctagcttgaatggattcattactcatcattagttattttctatggttttgctaaccttgaattgcttgttttgcttttatttcttgtattggctgaattttatcattcagcttttttttttttttaatatgcttgagaatgttcagttgtggtttttgttgatataaaattcttgattcacactgtccctgcaaactgcagactttgctcactgccttttggcgttgaggatcactgtgtagaagtctgagccaccataagttttttgttgatagtatgtttgaattcttttgttgtttttaaattagctctgagagattgggtgtggtggctaatgcctgtattcccagcacattgggaggccgaggcaagaggattgcttgagcctaggagtttgagaacagcctgggcaacatagcaagaccctgtctctacaaaacaatttttaaaaaaattagctgggcatgctggcacctgcctgtggtcccagctacttcggaggctgagccagaaggatctcttgagcccaggagttaaggttgcggtgagttatgatcgtgtcattgtactccaacctttaccctatctccaaaaaaaaaaaaaaaaaaaaaggcttaaagaaaaggaagtagggcctttagtttgtggcctttacctggacaaacaattaattctatttccccaagttatttttgttctgtactgagttttaattattgtgtcgttgttttgcccaaagttcattttctaatggtgttcaattaagaagttatacagttttagaagttatgtgtgtgtgtgtgttgtgtttttgtatgaaaatggggctaacagtttggaaaccaagttgcaaatgctgctggagttaatcttttttgtcactaaaagatgactcagttacctaaaattagaacaatttttcctgtttgtggtttggaatcccagctcttaatcagtttgcatcttagttccaaatttgtagccatggataacttccatgaaaccacagctttctcttgaaagagcaaagagcatgtaatatattaatagagctgtcaagtttgaaatgctacatctcagaaagtactttatgtgcagactaaaatctgcaaacaatctcagagcctaaaaacagattgcataagctgttgcttgatctctgtgagaggcaattagtagtgagtatgcttgttgaactcatgtggtctgggtttgacttcaagaccaggtaggtcctccctgacctgtgattcagaataagctctaacacctgtcttatttcagtttcctcatttgtaaatacaacagtgtctcgtctacctcatgggctgtgtgtctatttaatgagatacaaatttgtgaaagcttagagcacagcacttgccagtagtaggtgctcagtgattttttttttttttttggtcttttacctccctttccttttggtctgtcaaaaagatagtatttgtccagtctagttgatgaggttattgggagcagaactaaagtgatagagataaaaatctattaaaaagccaagagaatataaccttgtgtgattataaataataaaaatttaaaaatagagtttgaaaataaaaatacatactttttatagcaaatgtattcaaatagtgaaggagtaagaataaacaggtttggcttttaccttatagacccataaaatgattatatttttacagagatttgttaatttatgctcatttttttaaatttaaaatttttgtgggtacatcgtaggtgtatatatatttatgtatgctcattcttataagcctattttctccataagttcctagtatctctatgcacacattctctacctgtaccatattctgagatttataatataacgacatgtagggttgaaattggaacagtaacaataacaaatctgtcctggtgaaatgctggtcattgggaaatacaaccaccagaggcagagcaatgtaggataactttctggtttcataagacgttttgaaagcctacatgatatagaccagctgccagatgattgatttggttttggcctccccattctataatttcaagtcaccaggcagagctgcttctgatcctcatctgctcttcagtgtcttaaacactgatgggcaggaaacgcctgggtgtgcctagctcagaagctgagggcagggagcctctgccctcctgagcctggggctgctggggtggaaaggctggagcagtaagctctgtctcaggacaccacatgtgccagccatgttctaaagtcaggacttgggaactgcgtgggtgctggggaggttgtctcacctgtgaaagagggagactgaactccttccttctgtggggattggtgtgctgggccctgggaaatctctattaatattgcttccctttggttcttttcatttaggtagtttatgtggtggtgaatactaaactttcttttctttctttttttgttttttgacacagtctctttgtcaccgaggctggagtgtagtggtgtgacctcggctcattgcaacctccacctccccgggttcaagtgattctcctgcctcagcctcctgcgagtagctgggattacaggcgcatgccaccatgcccaactaactttttgtatttttagtagagatggggtttcaccatgtcggccaggctggtcttgaactcctgacctcaggtgatttgcctcccaaagtgctgggattgtaggtgtgaaccaccgcgtccggtcctattttcttttaaattaaactaaatgatattcattattgctcttccacttttatgcttgttcattcttttaaatattttctattaataagttaacttttgaatagccttcttgggggaatgcagagatcttgctgttggattcatttttctctttcctgcattcattttttatttgttatgttttgatggatgaaattttgtctatagtttatggtcttcataatgtattacatattttgtctttcactttattatgctaccttggattttttattgatcttctcatccactcatctgccccctttgttttaaacctgagtttgtctgtatttcccctctcagtggctttggcagctgggacacagttgtgaactgtttcaggtatctcattcttgaaacttagctttttgccttcgatgagaaaatgaaactggcccagctttgaatatggtaattcctgttctgccttcatggtcccgggggatgggttttcttttcgagcgtggagatgaaaagttgtccctggttagtgtgccctttgtttaggaacagggtgaatcttgtcatttcttttactttcctttttgctttggccaccaaatttagagctgaatttgtggctcaacttgaataattttggcatatctatgtttaacattttctcattggctttgatcttttgaaattttttctgtaattttttggatcttgatccgtaacatttttatgtgattttgtttttcattgtgtatgttcttataagttgccccaagaccattatagaatgaagtgagatacataagttaataattggctgggtgtggtggctcacgcctgtaatccctgtactttgagaggctgaggcgggcaaattgcttgaggtcaggagtttaagaccagcctggccaacatggcgaaaccccatctccactaaaaatacaaaaattagctgggcctggtggcgcttgcctgtaatcccagctacttaggaggttgaggcaggaggattgcttgaacttgggaggtggaggttgcagtgagccgagattgtgccactgccctccagcctgggtgacagagtgagactctgtctcaataataataataataaaaattgcaaaagttattatgcttgttctctaataacttgtctcttttcatttttcattgtgttcacatactatttaaaatataaatgacctttagattttccatagtatgtgcgctgtgcagtaatttctatgtctctattttcagcatgatctttcttcccaaaggttgcagggagagtagctgaagaaaggggtgcagtgctgggccacgaggtgggctactgcatccgctttgatgactgcaccgaccagctggccacgagaattaaggtaaagtgctcaagctgcttttcctagtggaaataaggaagaaggttattttgggagaattaaaaacatgtagtccttgctgctgtacaggacattgataccatggcagaaagtgaagaaaagtatcctgacattcagagactttagtcagctaggagacagagagctcttccttttttcttttttttttttttttttgagacagagtctctctctgtcacccaggctggagtgcggtggcacgatctctgcttgctgcaagctccgcctcctgggttcacgccattctccttcctcagcctcccgagtagctgggactacaggcgaccgtcaccacacccggctaagttttttttttttttttttttttgtatttttagtagagacggggtttcactgtgttagccaggatggtctcaatctcctgactcgtgatccacctgcctcagcctcccaaagtgctgggattacaggcgtgagccactgtgcccggccgacacagggctctttcaaagagtcctgcaatcttatcccagaaaggagcttggaagtcaggtttagtccttgattccaaagatgaagaggttaagggcttggaaggttgaatgacttgcctgatattatatgccaatcagtgataggaccaagactcaaagctgtcttttcttatgtgtattttattgtattttcactgactcaaatagcaatcgaaatatagaaacaagcctgtaaaaggcttaaaaatagagtagtataagttgatgaagtgtagaattcatgaatgttgtttcactaattagtacttttccattttcatatgaaaatggattttacatgtgtgttctttggccttgttgctaatgttaaaataattagtatcaatagtaatcagtgtataatcaactcaacagggtgtgtactacctaccaccgtgctagaatcaaagtctaatcagacagtgcaataaaacagtgaatgaaaataatctgatgaaatgaaaattgattattagaatctcagttacctcttaatttgcaacagaggaaaattgaaaatcagatgagctgaatgaccaatgtagtgatttgtaaaaatgtagaccttattttccagattgccatattttgttatattcattttgctaggtgaagggaatatttttctgtaccatcaaatatatttgaactagctaattttcagtggtttgcataaccatgaaaacctttgagccgtccataaaaaccttttgtattccatttggtcacaatttcaaggtgctcagttctcgactggtgatttgtcattggtggaagttctcactacgtatgtatgtggcagctagtaccaggtccaagaaaaatatgatggcaatgcatcctgctcttaaaacaaaaaaagtaaaaaacacctaagatacagcatgcaagggagatggtttaacctgaaaacaaattcagtacgttaagaaggctgttactgtatgtgtctgaagcattttataaagattcattaatctgaaataatattagctgacttttcttaaacactactctgtcctaggtcctatgctaaacgctttacatgtacagtcagtcctctgcatcctgcgggttctgcatctgtggattcaaccaaccttgaattgctaatattacaaaataaaaataaaaaataatgtaaatttaaaaaaatacagtataacaactatttacataacatttacattgttttagtcattctaaataatctagagatgatttaaaatatatgggagggtatgcataggttacatgcaaatactatgccatcttatataatggacttgagcatctgcagattttggtgtgggttgggggggtttctagaaccaaccccacaaggataccgaggaactactatactatcttatttatttttcacattaacttggtgaggtaaatactttgattacctcattttacaaatgagcaatcagggacagagaagatgagtaacttgtccaaggttcacacagcttagtaagaggtagagccaggatctgaactcccagcagtctgacaccatagcccatgtgcttaaccatgatcctatctagagtctgtaaaataatattaattgaagtttaagttaataacctcaagaactgcaatctatagtctttgggacatttgaagagcaattatcttacacttagggtgtttctttgggcagataccagttagtcttcactgcctctttatcgatagtactggtggtgcaagcccagaggaaatggggcatagctgatgttcccataataaaggcaagtgaaattctgctcaaagatttgcaactccagctgaggaccctgtgtttaaagccttttgtgaacaattacattgcttgataacgaaaatatgggggcattttctcacagtcctttgtgggaatttacttgtacacatgctggcaaagaggttgcacttgaacttaaaaaataccattaatatgtagtgtaagtgaattatttctaaagctttgtgtttttattttttagtttcttactgatggaatgctggtcagggaaatgatggttgatccgttgttaacaaaatataggtaaatgtgtttttcttatgatagctttcctagtttccaaagtccccaggtagacggagaagcaggtgtgttagtagctgggattcacgtctgtgttcagctgccccaaagcttttctcttgaccttggctgttgggacccttggtgtttttctcagaatttaaatagtatggccctttacagacactcaaaaatgggcacattaaaattcctatcattacttagtctggtgacttgtcctttttattttgccttgtcacactccagtattgatggtgactgcagagaactaactgccctgtgttaaatgtaatatacagagtccaaataattttttatcacttccccctctttgtctatctgtctgtcactcacagcattaaagctgtcctacctaggctctggtgttctcgaggagagtgtcacatttgaccccctggcccacgtgtgtcacaactgtagtcagctacctctttgactgttgttatagcttaacagtcttcagatggttgggctttgttctgatttttatgtgttctgtggggttataggttggttatgttttcatttaaaatcagatattaaattctgttggaattcagtgtggatggtaaaacgcttaaagataacaatagtacactttttaaaattcaggtatgttaatgtcaccgtttttattaacctaagaattgcctcattgtcaaagaagagtgacttaggtttacttttgatgcaaagtgattgtatgaggactaaatacccagaagctctttgatggtctagatgagatgatgtgtggcttttttagaggctcactgagagcttctctttgattcttagtgtcatcatgctggatgaagcccacgagaggaccttgtacactgacattgccattggcttgctaaaaaaggtatgacttcactgccagcttttcattgtgtgtgtttattttattgcctaattacaaaagcaactgtagcaacttggaaagtacaacaaaataccaaggaagaaaattaaaatcatccataatcctacccattcagagaatatcagtggtagaatgttggtatattttcttctcttttctgtgtgtgtgtgtgtgtgtgtgagtgagtgtgtgtgtacttggatctgttttggcatactagggattgattgaattatatatactaatttgtatcttgcatatttcccttaacattacattaggatcatttttctgtgtcatttaaatattctctgaagatattatttttaatggctatttaatcacatctctatcataaagtatttaacttcccctactgttagcaatttatatggcttgcagattttaaatattataaatactgttgtagcaagcacccttgtaattgaatctgctgcatttctgtttattttctttaactttttattattaaggtttcatacatatcccaaagaagtgtataatgacccccatgtacccttcatctggcttcaacaattacaactcacagccaatcttgtttcaatcttaacctccactctctcctcccttcccatattttctgattgttttctttggacagattcccaattagagtctagaaagaagtggtagaacagggtgattaagagcataggcattgagtcagactacctgggttcaaattctggctttgctgagtttactcatctctaaaatggggaaaatagtagtctctatatctgtgctggtatactttcctttatggtagccactagccacctgtagctattgagataaaagttaattaaaatagaagaaagtaaaaaaattcaggttctcagtcacgttggctatttttcttttcttctctcttttttttctttttttgagacggagttttgcccttgttgcccaggcgggaatacaatggcgtgatcttggctcaccgcaacctctgcctcccaggttcaagcgattcttctgcctcagccttcccgagtagctgggattacaggcatttgccaccatgcctggctaattttgtatttttagtagagatggggtttggttcctccatgttagtcaggctggtcttgaactcccaacctcaggtgatctgcctgcctcggcctcccaaagtgttgggattacaggcgtgagccactgtgcccggccacattggctatttttcttttctttttttttttttttcacgttggctatttttcaagggctctatagccacaggtggctagtggcttatgcatcggacagtacaaataaggaaagttttcatcattgcagagagttcttttagacataggtactgtatattgtgatttgttatgaagcttaagtaagatagcaaaaaacttttaggttggtgcctggcatagggtcacagctagactgtgaggttcttttgtgcaaattagaaaaagatgttccctctgggaggatgtctagagctaggtgggaggcaggtggaccggattgctgaagcccctagccccctcagccaggcatctttgcacagtgggtacactgtgtacctgtatgcagggcctctgggctagcacataagttagtctgtattagttgttattattattattttcattgttattttattccattgccaaagatttagattttttgatactttaagggaattattgtaccatgttattacctttttcaggaacggtataataagagggccgatttcactgaatctttgccaacactgagtattagccttaaaaaaataaatccttgccaatgggatagatggggaaaaaaaaatctcattgttattatatatcttagctgtagctcatttggtcacttctccaatgcctgttgattatgtgtttctttgagtaactgttaatatcttttatctcttttttttttgccatatttctgtcttggtgttatcatttattgtttgtttgcttttaatatactttttcatacatagattcaaactatcttgagacccaggtgtcaggaaaaaatggttttattctcagtaaattcaaatttgggtcttaaagcttctttatagtttttataatttaaaaaaatttactttggaaaattgcatacatttacaaaattggaagtaatagtgtaatgacccccccccccctttattgacaattattaatttgtagtcagtcctttcatctgtaagctcccttacctcctcctcaggcaaaaaagaaaaaaaaagacactgaatttttgaaatacatttcagatatcaaatgatctcatccataagtgttgcactattatcattatttccaaatgtcttcttttttagattcagaaaaagcgaggggatcttcgattgattgtagcttcagccactctggatgcagacgtaagagccttgcctcccctttcctcctctcctcacaaacacttttgtcctatatatccttgggaagttacctctagcaagagcttatctttggcagaatgccctatcttctttatgggaccatctgatgtcctagatttcatataatcagaggttactccttttcagcttgtgaaattagactgtaattaattgagctcataattacctacctgtcttgtttatctacatactgtctttctccccacttacacagcttctttttgttgttttttcagtataagcctgtatttcttgaatttgtttatttatgactatactgtatagatttagatttttctgtgcaattgaagtttctcctgggctgggcacggtggctcacacctgtaatcccagcactttgggaggctgaggtgggtggatcacttgaggtcaggagtttgaggccagcctggccaacatggtgaaaccccgtctctactaaaaatgcaaaattagctgggcgtagtagtacatgcctataatcccagctacttgggaggctgaggcaggagaattgcttgaaactgggaggcagaggttgcagtgagctgagatcgctccattgcactccagcttgggcaacaagagcaaaacttcatctcaaaaaaaaaaaaaagtttctcctgtatatataataatttccatgttaaagttttctgtggctaggtttacattatttttctctcttgtggacctatagtttaaacagcagctcaactcaacaaatacttttgaccacttactatatttacatgcagaaatagatgtttgcagttcagtgtgttcaaagttctgaggcagctaaggagggagcccttaactccagccagctggggggtgtccagaaactttcgcagaggtggtgacctaccagctgtgcttgaaagatggacagccgttttccagatggatgaaggtggggaagggcaccctaaatataagtgaaatcacagggacatgaccatgagttcatggagcttcgagtcttatcttacctgccaggccctcatgggtgaattacccttgaactccctctctgactttatcttcttccactttctccagtgctccctacatttcagcctcactggtctccttgctgttcctcaaaacaacccaggcatgcttctgctctggaggaaccctctttttagaccattccttccccggacagcctaaggttctctcctaatttcattccagttttgagcatttattatctcctcagagaggcgctctctaaaacagcaccccagttgctctttattcccttattctgattttttttatgtttctcacttgtctatcactatttaacattatatgcattgtttattgtgtgtctcctgtcactaaaatataagctccatgaagatcaggactttgtcttattttatctcttccacctaaaacaatgtctagcacagagtaggcacttgggttgaatgaattttgactgactgggaagtaatggaagattaaaatggggaggttggggtcagatgacggaaagccttagaggctcagccagagaggatgaactccatcctgtatctggttgggagccatgggaacatgtgagagagggcagtgacttcatcatgtttgagctctataaagatcattctgagtgctgtgtataggagatgagagtagatatggagtctctagtaaggaggccagttctgaaatccaggtgagatgtggtccctggctcctggctcctagtctccctgtggcttctgggatacagaacaacttggagagagagaaagcttaccatagcgaaggtaaatgtccaacgtgtcccgagactggtttctcagacctttccacaggctgtaggagtctgttgttttaggtctgcccatggtaacttttgggttaaagctcctctgttgccctgtttaattgtcatctccctcacccatggtatctgctggcatgctattttgtggactgtggctgacttcacctctagttagctcctctgtggctacattacacagaacatctgtatctctttttcaccccccaccttaaaaattattaaattaagttaaaaattattccagtttttattatgttgaaaactataatgtccaagtcttttcttagattcattttatttatttatttatttatttatttatttatttattttttgacaccaagtctcactgtcttgcccaggctggagtacagtggtgtgatctcagctcactgcaacctctgcttcccaggttcaagtgattctcgtgcttcagcctcccaagtagctgggactgcaggcatgagccaccatgcctggttaatttttgtatttttagtagagatggggtctcatcatgttggccaggctggtctcaaactccggacctcaggtgatcctcccgccttggactcccaaagtgctggatttacaggcatgaaccaccacgcctggccagattcattgttaattaatacttactaattgttcacaattgccttttattgtcttggtggaacacagagatgaaaaaaatagcttctttcagttctgtctatggtagttgatatagatgactttctggaagcaattttgtaagcgggaagacagcatgtaggaactttgtcatgccttgctctgctgtggtacgggacatgctggacctctggtaagctgggccattccttcttatcctgtccttgctgctcagccagtgcctcctgtgtgaggggaacggtggtttctaagtgtctgtgaatgggggatctgtgtgtgtgagtcatctctgtgtgggttgtgggtccgtgtgtgaggggcctacgtgaggtatgggatgtgagttcgtatgtgagtgaaagaaagaaagaggatataagtgggcgaaagagggcaagaatgaggactatgtgggagtggcaggggggttgggtgtggcttaggaaacattttgatctagaggcgtagggaagtccagaactcatcccctgccccccagcggctgggtctgtgggtgacagactaatttcaaacctcctagagctagggctgctgataggccacctgccgtggtttctctcagggactggggtggcccagcctgcagacaaagacagcagtggctgcagccgggaggcagagacctgcagagcatgatggggctgatcgaatagctgctttggttgctttatctgctttcttaatgtaagcccaattaaacgaacaattatataacatgactggatataattatgaagtatttattgatcctgtatcacgtgatgatattgcttttcttttatttgcgtccaactgcatggcagaatatatggttgctggtagctcccatagtttttttgtcataagtccagctacttgaagagagactaatttctctttccagattcttagagaaggaacttagcatcagctggggtcaggtctccaccctggaccagtctacatgggccaaggctgttggccaatcatgggtgtgttgggtagacatagctgcttatcggccactccagtgggttaggaaggagcaggtaccagggaaggagcctatggtgagctagaagacaaccctgcagatggccatatcatttacattccatttcatagactgtcccctgcctttttatgatgtatgcttcttaccatgtctgtatgtcaatgtgaccccacctctttcaaacctgactcaaattcttcttttctgggtgtgttgaacttattttactcttcttgttccttgattctgcctcaagattcttgcattgttggtactatatttatttacttttttatgtattttgtatttccaaataaagatacaagataaagatcttaaaggtcttgtgccttctcagtaaatgctgagtcttaattctttttgttttgagacagagtttcactcttgttgcccaggctggtgtgcaatggagtgatctcggcccactgcagcctccgcctcgcaggttcaaacgattctcctgcctcagccttcctagtagctgggattacaggcgcctgccaccacgctcagccaatttttttgtatttttagtagagatggggtttcactatgttggccaggctggttttgaactcctgacctcaggccatccacccgccttggcctcccaaagtgccaccgcatgagccaccgcatccggccgagtcttaattcttgaaagagtaactctttacttttcagtaccacatagtccttaacggtaaggtttaggcatctactctaacaaaattgtcaaggcatcatcttcttccttgttctgcttgcttttttggtaacattcacccttgtccaagccctttggtaaaatcttcctccttctccttccatagctcctggagccctgctgacttccctctcctacctccttgttggcttcctcttgggccccttctctgtctgctcttccttctcaaggctgcacacccctgtggtccctggttcagctgagccttcgtgcttgtggcagtcttgactgtgtgcttgcacaccagccttagctgtctgacagctggctagccacagacatcctaaactcataaacttgtgactctctgattctccatctcagtctctttctcatgatcatagtcatttaggccaagacctccattgctttaagaagtttttatccccggtcgagtaagagtcactctagccttctttccaatgtgcacgtgtgtgcacgttcactcactgattgccagttcccaccagctgtatctctggaatgctttgcccaggttcacactttgtctcccctgcactattatgatagcttcattaattagtttgtttgcctcgaatctcttatttcctctgccctcctccaaaatggccactggagtctgggattcagctcacaggtctgataatatcatgcccatcctcactgcccttgtcttgcccatcgaataaagtgccagtgcagctgatcacttgggtcccttcagagttatggctgacatcacttattgagtgccattctaggctagatgtgtgtcacaactatcccacatagtttatttgaacctcacagcaaccttgcagggtggatagcagtttgtccattttgcagatgagagagctgactcagagatgaggaggcctagaccttgcctctgtcctcccttagggacccctttacattttagtccatactgtgctattgtcctgggaagggatgtctcccccttcccagccagtaataatcctccttagcctttacagtgcaggcaagggatactgctttctccatgaagctctccctgaaagccggtagttcttaacttttccttctatcagattgcaatctgcagctctttcctggtcacagggtcatctgcctcagggattattttatgatcaactctttgcacgtctgccttctgtgaactgtttactcttttggggcatggggtgtctgttcccacttgtttgtatgtcacttctagtgtacctgtgctgtgcatgtcatagggatgcaggaaggctgaagcaacttgaagggaatttacccaaaagaaagtgaacaggagtactgtgtggaattctgcatagcaaaacatagttttgttgacatgaggcactttgatgtctgtgcttattcttctcaattttgaggttaatatataacatccctgtattttgtggttaaatccagtttactcttttaaaagtacccctcagagccccttcacttagcgtttgatgccattcgttagcacagctcctgggctcctgggtttcctggagcaggatgggcatgttttgtaaaggtacatagggaaataaagacaagctttgtagttatgtagccaggcctcagggaaatgagtagaggtggggaatggaaagggcacccagattcaaataatggagcactccacccgacgggatatccatgccccctctgcagtgggcaccagctgcttcccatctggtgctcacttgcctgcctgcatggtcacttagctcttctcagtctcagcttctctttgtaccttagggtcacattccccaagagaggatctttggtggcgtttccttcccccatcattggctggagccctcaagacaggtctccttgtgggctgcaagtggtggtcaagtaccattaaataggatgtggacacctgtttggcagaaactgccaagagacacttctcccaacagggtactgcacgagtgttggggaagtacatgattgatggcctaccccatacaaagcctcgcactcactactgtagggcgtgtaaagatggagaagacactatccctgccatcaagtggcctaaaaccagtaacaatggggccggaaacacacctactgttcacagaaggaaaagtttcctatcaaatgatcatatctgtgttttccagatagagttacccaccaacctcatctaacctgtactgaacttgagtcacacctttgacctaatttttgcttaaatgaaatacagaggataggaataatataaataatactaaagctacatgttaactcagatgctatgctgaatgcagttttgaaatctaacctttattatttttattaaaactttagtaaagacactgtcattgaaatgtgattccccacaattacagttagaaaaatgtgaatttaaaaaatgtattttgcaacccataatctgtattgcacatatataatcttgctactcacctgtctttggcaagttttatattattttttctttccatgaatcgctacgaacctttttttctaagagaaatgaagaattaatttttttctttttagaaattccgggatttctttaatcaaaatgaaaccagtgatccagcaagggatacatgtgtgatccttacagtggaagggagaacatttccggtggatatcttttatctacaaaggtttgatgatgcttgaattctggatgatggtgtttagaaaactcagcctctgatgtagaatgtcagaactgcatttgctcacaactctaaaggatggggaggagcatgttttgtgtccctagtcattggtctagaatgttcttaccctgctccggatcactgctgaatttagtttaaactgttcacactgacatgcaagtttccgtaagtctgtggccagtagctcagccagagagagcaaaagtggtgaaaggttttggggagggaagcttgatagttttcagaactggggtttacaaggctgcctgtcagcaggggcagtattggtgatttgaatcatttggctctcagttctctacatccctagcgagaaggcccagttggcatttttaggagtagcctacttggacaaggaaggggccatcctaattcctgtactagtcactggacaaaaaaagaccaggagcctgttccagtggctgataaatccagagtcgtggacttgatttctgaatcgttttgttggagagctcatccatcagggccatccagccgacccatagatgctgctattggttaggagggaaaatgggctgggaagagcgtgggcttcagcactgggaccacagcttccgattttcactggtctgatgtctttgcatactaaagatagcacatctatttgtatgggtatatcatgttatttctttccaaataaagctaaaaatcatagttgacatataattatggattattcttgaatattagatttgaaaaaaatgaatatttattttgtttatcctgtactaattacctactgggcaggcccaaactcactttgatgagctttgctgccagattattagggtaattgatctgtaattaatgagcatattctagtgatgaattcatcccatttgtcttttcagtcctgttccagattatatcaaatcaactgtcgaaactgtggtgaaaattcaccagacagagggagacggagacgttttagcatttcttactggccaggtaatgccactgtacttctctgatgaatagacatgttaagacagcaccaaaagtaatacagagccttgttactttactcagtcatgtatttcatgttttgttgtattttgtggttccataattgtgtagaaaattgatttgatgtcattcatctaccatctagattgtcagggactcgttagcccctgcctgttctgtctgcagagggttaaatgtttttttaaatgtattagctgattccaaaataaactaggtagttgagtgagggctattttgtttgccagaattggatactacattaggtccatgtcctgcacacatgttgctgctgtgtacctctttttccagtgacacctttacagctcatcctggaggtgataagtggccatattactggtaaaacaactgaacagacccaagtgctcgctgacggtggccagcactattcagacctgccctccaactgtaatcttttccactgccaaacactttccatggttcagtaatcttttttggagaaagcttacagtgattttatatgctgcaacttgtctatatgcatgagatgcttgtttgacaccgtatatgtatgctgagtaaaatagtcatcgtttttatttattgggaactcttccattcattgcagatcataccgagtttttagtaactaatagtgtagttgcaaaatttcacccattgtcatcattgtgtattagcatttaattaaataccatcccagagtggaacatgacggcactgaaattcttgaatctgaccaaaattaaagtccagatcccaacttttattttctttcagtatgataaaatagcatgctttaaattgatctcggtttctttggttcctggttcaacgtctttaggaagaggtagaaactgttgtgtcgatgctcatcgagcaggctcgagcactagctcgcactgggatgaagagacacctccgagttctccccatgtatgcaggactgccttcctttgagcaaatgaaagtgtttgaaagggtgtcacgcagtgtcagaaaggtgagactatcctgatgaccaagggtgttggcagccgtctataatcataatgatgctcctttacttgttttgaaacttgctaaacacaaggcagacttctaggtccatatttctgtgtagtagatctaaaagcacacaataaataatacattgtgaagatttcttttttttttgagatggagtctcgctctgttgcccaggctggagtgcagtggcgcgatctcagctcactgcaagctctgcctcccgggttcacgccattctcctgcctcagcctcctgagtagctgggactacaggcgcccgccaccacacccggctaatttttttttgtatttttagtagagacggggtttcactaagttagccaggatggtctcgatctcctgaccttgtgatccgcccaccttggcctcccaaagtgctgggattacaggcgtcagccaccgtgcccggcctgttgtgaagattctaaacctgtcccactgaaggatcactttgacagtagttatcagatcaggtgacttctcttttcttctcttctgccttcctaatatttcccacgacacatgcttactttggcttaagggattgtttagggggattgaggtcagtcaggagcaatagaaaaattggtacacatggtttctaaataatttgttttaagtatcagcttgcctattttaaagggccaagtttaaatcaattaattcaaggtgtggcttaaaaatgtttagccttgaagtgagagtgaggaagggtgtggtggaaagcattggtttgaaggagctggcaggcagccagtccacctgggcctgactctgccttttcctttcattagatgaggactgcacagaaccagcccgaggacagcttttactgtagtagctatttatcaacagatggcagagaatagagcaggtgagggatggtctgaggatccactcccaatttcagaccacctggaagagggtgctcagccccttgaccattgggatggagcaacatgagtctgccctgtcaaacattaattgcagccagccaatcaggagacctggattctgcccctgagctactatgtgccttgggacaactgacttaacctcgaatctgagtttttgcagctgtaaaacgtaaataataataactttcagataggtggttttatagcataacatcttaatcccaactacataaaaatattagaaagattattttataaaatgatcatttataaaataatttttataaaatgatttataaaatgtaaagtgcctgaaaaaagttctaactgctatatatatgtgtcccctgctacttaaacccttcaggggcagctcccaatgtactgggaataaaattcaaatacctcatggtggcccagagaccacatatgattgcatatctgcctccctctgcaacctcatcttgtactttgtattttggctgcactggctgtttctccttcctttgaactgtttcttattcttggatctctatagggttggctgctgcttgttactcaggtctctgctcaaaatctttcacagaggctctgcctggccaacaaaagtaaagtagcatgccctattattacaataatatataatatacatgttatatactacatcatatcatattgcctcattgtgttaatattttctttatagtatttgttgttctctgaaattatcttcttgtttatgttcagcatgtcttcaccctaaacactcaaactagaatgtaaactctggcagagcaggggccttgtctgtcttgtttatcctacatcccagcaccttgaacagtgcttggcaaagtgcacaccctcagaaagtaatcatgatatgaatgaataaatgactatacctgcgcaagatggagggtgatttactttggttatgccaaagggaaaaactaacaaatgctaggctctgatcactttatatattaattgtatatagtcccttcagtagccctaggggaggtggtaaatcttattatgtagatgaggaaacaggttcaggaggttgagtaacttgtccagggtcacatgattagggagaattcaaacccagggcaccccctgacttggaaactcacagtctttctagtatattaaactgcctctcacagattctgcaatgttggaaatgttaaatcttttaggatttttacgagtttgttaaaagcaaaaagaataaaatgagttttattcttctttctgtggggaacgtaggtgatagtggccaccaatgtggcagaaacctctatcacaatcagcggcattgtgtatgtgatcgactgtggctttgtgaaactccgagcctacaatcccaggacagctattgaatgcttggtggtggtgccagtctcccaggcatcagctaatcagcgagcaggacgtggtggtcgtagtcgctcgggaaaatgttatcgcctttatacaggttagtgtggctttccctaagggtttttgactttcttatagtcagcctgggcaacagagtgtagcaaatgtttactcctaatggtagaacttaacataaaatacaggccttcctcacaaggccctgtgtaatcagatccccactgctttcctcactctaaatatggtgtttctttgttactagtccccattggccaaagctggcctgtgagtgactgcttatttgctatcctgttctaacctaacatctgggcacaggcctgtgtagccatttgtccctagggtgtgggctgtgtgtcctggagcctgtctttcttgcctttctttcttgacttaatgtgctgtttttgtattccaagatccctgagtcttgcggagcctcacattgggttccccttttacttctggttcagagcatctttgccaagtgaaaatggaaggtctgtccggagactcattcatagaaaacaaatagttggtgagctcctcctctgtgctgtgcatcatgctaggctctgagggaacagaaggcaattttaatactgtctcagcctttctggagctttctatccagcttgaagacagccttacctatagacagtgatggacccagagctgctctttctctgcacttctcttctgtggggaatgctgctgacattttccccagttgtccagactcaatttccaagtcattgttaattctcttctttatccagtatccatctgcattcacttaaccaggcccagggttttttattttgttttgtttcttctggtgtggctgcccctaaagaaggtccaggggttttagctctgccatttgtctcttcttttcctttctggttattattgtccttgttcagtctttgatgttgatctttcttttagcagatgtttgcagagcacctgctgtatgctggccacggtgctagagcttggagatctggggctagtaaccatggtctgtggccacagtgactgacagtctggtggtggaggtagacctcaaaacagatcagcatattatggtatgatagggagccataaagaatcgggagccttggaagcagagagcagaggcttttccttgggctgttttccctgcccagcagatcttccttatctttcaaatcctctctcagatggcagttccctcatgaagctaccttagatgccttctcctagaagctggtgttatccttctggggatttggggagtacttcacaaccagggtgttgtttgagcctgatcttactggcaatacagtccttatctaggcgaagaggtgattggggagattcaatttcagcgcaccaggcagagggaatggaaggtacaagtacttgcagggaaggaagtgggtttggaacattcacagaagggagggaataggcagaacccagggcctgaggaccaagggcaaccactgaagatgctaagaaggaatgactagagtggaaaagggagagccaggactgaaagggattctgacatgcagagaaggtttcaagacatttttctcttcaaaaattatttattggggtgaaatttacataacacaacattaaacacattaaagtgaacaatttattatattcacaatgttgtgtgaccactgcctccatctagtttcagaacatttcagccactccagaataaaatcccttatgctttaagcagtttctccccattctttctggctaccagtccctggaaatcaccaacctgtgttcttctcaatggatttctctcttttggatatttcatataaaaagtcatacaatatgtgaccttttgtgtctggcttcttttagcataatggttttgaggcttatctacattgtagcatgtacttcattcctttttattactgactaatattctgttgtatagataaaccacactttgtttattcatttattagttgtggacatttgggctgtttttgccttttggctattgtgaatagtgctggtatgaacctgcatgtacatgtacttgagtaggtgtttttaattcgttttggctattacagggttatatgtaattttgtttaacttttaaggagctcaagttacttttaaagaggccagcattatctcatgtgccaagaaatcatggactaaagataggcaggtggatttgggtgaaaagtcactgaatccctttgcatgagcagtttagtggaagtggggttggggagggcccctgactgtaatgagtgcattggtgtccagcctctaggcctccacaggagcctccagaaagtattgctttgaacagggtaccacctgctcagaccctccacattttctcaaaccatccaggatttttcctcagcttatcttctcctactaaccactacaaattgcttctcagctgaactactacacgacatgctctctgcatgagaaacgcttagataccttttccttgagctgtttcctctttgcccaacagatcctccttgtccttcaaatcctccctcaaatggcaacatgcagcttccctggaggccttcttccagccaccctgcttcctccttccctgagcctccatttctctttgggaggaccactccttgggacttttcctatttctccttgagggtcaactgtttctggtccaggtcccaggcccctgcatatcactgaagcttttcaaggggattggctgtgactcctacagcttctggccccatgcttcacacacttgagtcctcaggagagcttgcctgtcattgaacttttaggaaacacccacttcctgtgagcttttcagcagggtggtcctcttatgtgttaactttgtttctcctttggttagtagtgtgcttggaaaatggggttatcctatcaagaagctgtaccccaaattctcttgaaactaaaggaagtagctcatttggaacttcctgctgttggccgtcatccagaaccttctagttagacccaatttgtatcaattagtccacagaatattggttgtctgttttctcaaagaaaacctttctgaagtttttcggggatagtggtatttcttcatggcacttttttttttttcctctagttaactaaagctttatgatctaaatggaagttgggtcacccttgtattgtttaagaagggtgtacatcagttacaatgttgactgatgtgggaggttttggtgggtggagcattctctatataatccttaagctttctgaatatacatgaaaatgagttaatctcttcctcttttttccccacccttcctgcctagcttttataaaaaggccttcttccaaagtctcttctccttccccctccctttctgcccttcctgtcttgggatctctgtgtcttaggatgctttttcctgtgtaaggtcacctcttcttcctggtagggcatgtaaacattcatttcttggtttggggcagcattggattctgggaatgatattgtgtacctggcttgttgatttaaaaatttgatttggacaatttttgctctttataagatttggtcatttgttgtattttggtgatttatcttgaaattgttctttgcttgtatgtgaagctcttgcttccttgacttattccaaacagagatggtggcaactgggaactgatagtgattcagcaagtacttgttggtttgatttaatgttttgctgacaaaaaacattaaaaaacagaattttagataaagttttataaaggtgtattcaaatatatttatctaaggcattttaaaaatagaatggtctttcctaagtataaaaataactttatatcatggtatcatgtgcatctgcttctagaatcctagagacccttgttcaagatagagaagaaaatttgtcccttggcatagtgattgcatttgattgtgacatttggtcccaaacagttctgatttcctatcctcagaggaagcctttgacaagttgcctcagtctacggttcctgagatgcagcgtagtaatttggcacctgtcatcctgcagctgaaagcactaggaattgacaatgtcctcaggttccacttcatgtcggtaagtcctgcctgctgtctggggccatagggaggctagggagctcacagggggatgtcaggacattgtcgtagggcatgccatctttcctttttttccctactcaggtcatgtgttgtgtgtctgctttgcaaccaggccctgtgcaggacgtaggggaaaacagccagacaaggtagcctcaattcctattcttacatagttcctgttcttgtctgctggggaatagagacaagtaagtgggtaattacagagcagtgtgcccagggctctgagagacaaaggaagggcctcccaggtgaaacctgaaacccaaatagaatctcaccaggttaggagtggagagttccaggacagctagtctttgtagaggcctagatgcaggagtaccatgattgggggatccttcctgcagctttagatagagctgcaggaagacccttgtgcctgattgcttcctgagatgatttctaggagtagaatgactgggtcaaagggccgttgtcctgtttagggtcctgttacatggccagattgctttaccaatgtcaactctagcagtgcctgaatgcccaccttgtggtacttccattgtgccatgttatcttctttgggtttgctgatttgattggccagagagaggaaatcacctttattataattatttttaaatttttcataagatagatttttataaaaacatttattagtcagtttttatttcttctgagttgttaagctatttatctgttagaatttgtgtcagttagtgattttcaagagtcctttgaatattaaagacattaatttttataatatttcttacaaatattttctatttatattttactgttttttttttaatgtgtggacattctaaacatattcacagtaatctatttttgcctttatgatttctttggctattctttttttctttctttattttctgagacagtctcactctgtagcccaggctggagtgcagtggtgccatcttggctcactgcaacctctgcctcccaggctcaagtgattcttgtgcttcagcctcttgagtggctgggattacaggtgtgtgccaccacgcctggctaattttttatatttttagtagagacaaggttttgccttgttgaccaggctggtctcaaactcctgagcaggtcaggtgatccaccccgtctgggcctcccgaagtgctaggattataggcgtgagccaccacccccggcctctttggttattcttgcccttatgaagtacttcttatatttgggtcagttaatacatattctctcatattttcttctagaatttttatgatttgagaactttgttttttcccaactgtatatgatatgacaagtctggaaagtctggattcttggatagtaaagtccctaatgtcatatgtgatggtaaactaggtgaatgaaagaatagaacatacaaatatcaactcccccaaagaaaattgtgtacttaccataagtatagggaaaatggaccctttgattattggtgtagagtagaagatattataaagaaaagataaacaggctgagcgtggtggcttatgcctgtaatcccagcactttgggaggccgaggcaggtggatcacttgaggtccggacttcaagaccagcctggccaacatggtgaaaccccgtctctactaaaaatacaaaaattagccaggcatggtggcatgcgcctgtagtcccagctacttgggaggcttgaggcaggagaaacgcttgaacccgggaggtggaggttgcagtgagctgagattgtgccactgcactccagcctgggcaatagggtgagactctttcttaaaaaaaaagaaaagataaacagtatgtgctgatttgaaagcttatgaaaagccccgcatgtaaaattaaagaaaaacatacagtgacagaaatgacagatcagtatctcaaaaaatatgaagagtttttatatgcacatcatttacagtaaatattcactaaataaagctaaaggaaaaaaacagcacaaattcaaatttcaactatcattaggacatgttgagcttctctaggagagaggtgactgcacgttgatatagctataaaggatgactttacactaattttttttttttttgagacagagtctctctctgtcacccaggctggagtgcagttgtgcgatctcagctcattgcaacctctgcctcttgggttcaagtgattctcgtatctcagcctcccaagtagctgggactacaggaaagagccaccatgctcggttaattttttgtatttttagtagagacggggttttgccatgttggccaggatggtcttgaacgcctgacctcaggtgatctgcccaccttggcctcccaaagtgctgggattacaggtgtgagccactgtgcgcagttgactttacactaattaaatgattgagtataaacaaaaatggtgaaatcgaaaactgccacaatttgggaaagtaaattcctcccatgttataccgtttctgtccccatggaggactttctgacaacatttaatgagccgtagaaatgtctgctatttcttctcataaaaatttctcctgaaaaaataattcagaagaagaaaaaaagcttacatatgtgataatgcttatagcatttatattacatttaaaaatataaataatgaaaattatcgtaaaacttttggacagttgaaaaatgaaaaaaaaaatacaaatttatcttcacatatttccttctggttattatcccctgaaattgtggtttttatgattgaaattacagagtacatataattttgtatatttagcaatgttatttacaatggtgaaaaactggaacaatttaattgcccagcaataagaaaattgacttttttatggagtatgattgtcatagagtattatgcagccatcccaagtagttactgtgaagtttgtatgggtgcaagaaacaatgaaaacagaaaaacatgtagtgagaagaccacactaaaactatacataaacagtaattccagatatgttaaaacagtgtttctgtattatcccaaatcagttgaggtcacagagaaatactagtgaatgtgattagatgaaaatactatggataagatttttgtggagagggggataagttttttttgttaattgactggaaatcgggccaggaattgagtcagagctgaccttgttagctttttctgtaattgttaaaagcctagttcagagattgctattcctgttacctcatccactctcagtataaaagatcccacagggtttaagctccttcatttaagtgttgcccattttgcttctttgtagagaaagatgttgtaagcaccaaggaagggctagtggatcatttacatgatttgctcaatggtgatttgttgaatcctctctgtgtaatgaatccaataggtttagttcctgccctcgtgtgttcacctgtgtgtacggtcactacaacttttaaaaaagtttaactttggtctttggcaaacaaagtagggaaggtagactgggaaaaatgaggcctgagttcagctttgccaccaactgcctatatgaccttgttcagctgtcttttccttattgcagttcagtttcctcatctgtaaaactgagctaaaacaatgtgatgaataaaatacatttgttatgtgaatgcatttagaaaaaaatgctatgtgaatttagaaaaaatgcatttagaaaacatcctatgcagtttaaaaatgtactgtaattttattacctgggttattagaaaccacataatttagagagaaaaaatatgatgcctggcacttaggtgctcagtcaagatttgtagaaggaaaggaggtaaagatctggaaaatcagactgaggctcactacatcagctttgcttatgaactttaaggtctctagagctattattttttgaaattcagattcgacatatgttgtagtttccagacagggattaagaaaaaacaaattcagcgtatgttatttacccaccacggggcctggagtgggtctatgggggatgcaaagataaatcatccccgagccctgagtgctgcagtgtcctggggccccggtgtggtagaaggttgagtctgtgaagtaaaaattagaaatgtctcaggagggtttaaggaaaatgaagaggtagtttaagatagggacctatcacgtctgatggaggggaggatgagggagcacttcaaagggaaatgtttcatcaagctgagccttaaaggccaagcagtacaagggtgcctagaaggacaggaaggacatttcaagaggtgccaacagcaagaacagaaacatggaggctgggaagaatggggcatgttagaggggagaatggatttgaaaaggaaacagccacattttaatgtttgttgcccaaataaattgattcaggaagatttttatgttttttccagccccctccagcacagtcgatggttcaagccttggagttactgtatgctctgggaggtatgccagtttctctcatcattctctcttattatgtgttgtcttttgtgatattagtgaggtcatattcactttagggattttagtatcttcaggaatgggattggttctccccatatatataatccccctaatgatactttattgaaataggaagttgggaccataattagacacatgaaagctaattatgacagccagtatataaaacatgccagttcgtcagaagctattagtaagaatcaccagggctacactcctaagagatgtctagagatcagcagttccctaccaggatgtcagatcttacctccccagaccttttttctccacccaacaaccacatccttaaaaatcgtggctcagtattctctccctaaatcctcttcatttcattcctggagttgcttgtggagaattggggacattatcagcttctaacaccatgttacgggggaacttctattcagttgtcgattgaagatgttattaggttggtgcaaaaataattgtggtttttgccattgaaagtaatggcaaaacccgcaattgcttttgtcccaaccttaatagcgtttatcttgacatagagaaaatcatagtctgaattcaccgctttggggagtactgtttcttctgtgattggtaccacaaatgaatataatttccaattttgaattaagttttagtggagattttgctttttgagatttattttgagtgttactttttttttaagtagctgtattgaagtatagtttatgtactatacaattcactcgtttacagtgtacaaattcagaggcttttagcatattttcagggttgtgcaaccatcaccacagtctaattgtagagcatattcatcacccaaaaaagaaatctttacccattagcgccgaacttctcattctctttccccctagtcccccagcccaaggcaaccactctctggttcagtctctatagagagtttttatctctataggtgtgccttttctggacatttcatgtaaatggaattgtataatatgtggtcttttgtgattggcttctgtttcagtctgtctgctgttgctataacagaatgccagaggctgggtaatttctaaagaggtttatttgggtcacgattcaggtggctgaaagctccaagattaggcagctgtatttgaggagggcctcagcctgcttccactcaaggtggaaagcaaaaggagagtgggcgggtgcagagatcacatggcaagagaggaagccaggaagagaaacagaggaagccaggctcttttaagaacctgctgtcatgggaactaatccattactcaccctgggtaagggcattaatctgttcatgagggatcaccctcatgacccatacacttcccagtaggccccatctcccaacactgtcacgttggggatcaaatttcaacatgagctttggtggggacaaactacatccaaaccatagcagcttctttcatttagtatcatgtttcacaggttccttcatgttgtaacgtatattcataccttatccccttttatcactgaataatattctgttgtatggatataccacatattttttatccattcattagttgatagacatttgggttgtttccactttttggctgatataaataatgctgctataaatattagcatataaatgtggttttggtggacattcccaccagcaatgtatgagagttccagtttttccacattgttgccaatgcttgtaattgtcttttgtgttatagccatcctagtgggtgtgaaatggtatctcttggttttgatttgcgtttccctgatgagtcatgatgttgagcaccttttcgtgtgcttgctgcccatttgtaaatcttctttggagaaaagtctgttcaaatcctttgcccatttttatgtgtgctgttgtctttttttttttttttttttaaattgagttgaagttcttcatacattctgggcacatattcttatcagatatgtggtttgtaaatatttctcccatttttgtgttttggctttttacttacatgtacttactttttacttattagtattgtttgcagtacaaaaattttaagtttttgtgtggttccatttatctgtatttttcttttgttacgtgtgcccttggtgtcatgtctaagaaacttgcctaacttgtagtcattaagatattctcctaggttttatagttttggcccttacattaggtctgatccattttaagttacttttttggtatggagtgaggtaggggtccatcttcattcattatgttgattttacttctctgtgaatagccaattactgatttaaaagatctccagtgatttaaaagaccttcagctggatttacataagatcagcctggagtgaatgtgtgttggagaaggtttccacccccttcttctcaagcatgtaatgggaactcgaaagcacatttcctgggctgatctgtagtgaggatgagagaatgttgacagcataggagtttttatttgggctggtttttctccagtcaaacagaatgaaatttaagatatttcctatttcttcaataccctaaataagctggaaaagatagagggaccccccgcctccccccgccagcttcatttgatttcaagctgaattaccacctttaaagagatgtcttactgagctctgccttactgtgagatcttgcagcgtttaagtagtaaaacagtagtctatatcttgggaatccaatacctggatattggcaaggtattgccaatagagggcaagaagggcaggtggggagttgaaagagtcagcccagttcagcaaaatgttcaggaggcagttgcatgaacagggctggtgttggcaccagagggatctgggttagtgtttagattccaagttgctggccctgtagttgctcattgttgttctcattgtggctaataaagagatactcaagaccgggtaatttataaaggaaaggtttaatggactcacagttccacatggctggggaggcctcacagtcatggaagagcaaaggcatgtcttatatggcagcaggcaagagaacttgtgcaggggaactcccatttacaaagctatcagatcttgtgagacttattatcacgataacagtatgggggagactgcccctgtgattcagttacctccactcggccccgcccttgacatgtttacaattcaaggtgagatttgggtgggaacacagccaaaccatatcactcatttagtatgagaagggcacaggacacgggatgccatcgataccatcctggcacatctgtggcctgtccggtcctggaggtggtagaaagtccagacagtgagggggcaatggagatggcagagaaccaggagagttgggggccgggagctggcgaagagtagttccaagaagcagcggccagcagagccgagtgctgctgaggccatcaggaagatgccttgcgtttggtgctacccagttgttaggttcttgggaagagtggtctcttcggagtagtgggaacaggtgaggctcttgtggattgaggagagggtacaagcaggagaaggctgcagggggatttccttataattaagtccttgaatagaagtctttagaagtatcagttttttaaaaaattgggtattcaagagctcagtggagatcttttcttcttttaaggtaatggcactctagtgtcaaatggagtttggtgtagtgcatgaatcatcttttggatactttcttctttttagcatacattatcttttattctctcagcaactgtgtgccttccaacacaatggtacctgccttctgatttcttttgttgttcttatggcaggtctggacaaagactgtcgcctaactgaaccgcttggcatgagaattgcagagtttcctttgaatcccatgtttgccaaaatgctgcttgaatcaggtgggtagagcctgatagcttgaattgattttattttgactgtcagaggtgttgtttgcctgaattctgagcaccctggggaagagggtacaatatggtaaagaagtatatatatatctgtaacataacatttattgttttaaccattttatgtgtgtagttctgtgatacaaagtacgttcacattgttgtgcaaccatcagcaccatccatttctagaactttttccatcttttccattgaaactccatacttggtaaacacaaattccttattctctcctctgccccgcccctggcaaccaccactactttctgtctctatgaatttgactgctctgagaaccctcagaagtgcaatcacacagtatttgtccttgtgactctcttgtttctgttagcataatgtcttccaggttcatccatgttgtagtatgtgttaaaattttcttcatttttaaggcggaatagtattttattgtatatctataccatgttttgtttgtttatctgttgacagacactttggttgcttctaacttttggctattgtgaataatgctgctatgaacatggatacacaaatatcattttgagtccctgcttttatgtttattgggtatatagccagaagtggaattactaaatcatgataattctttaatttttaaaaatgtatttttaattgacaaataataattgtatatatttatgagatagagtgtgatgttttaatctatgtacacattgtagattcagtcaagcaaattaacatattcaccaactcaccaacttatcattttttttgtgctaagaatttgtgctaagaatgttaaaattctattctcttagcaattttgaaatatacgatacattattattaactgtggtcaccatgcagtgcaatagatcactaaaacctattcctccagtctaactgaaactttgtaccctttgatcaacacctcctctttctccattcaccccctgacccaggggatctcccagcctctggtaaccacctttctactctctgtttctatgagattgacttttttagattccatatatgagtgagatcatatggtgtttgtctttctgtgcctgccttatttcacttggcataatgtcctccagttccatttatgctgtcatgaatgacagtgttctcttcttttttaaggctgcatgttatttcattgtgtgtgtacatatttatataaaccacattttctttcttcattcatccagtgaatggacacttggattgcttccaaattgtggctgttgtaaataatgctgaaatgaatatgggaatgcagatatctccttgaaataccagtttcagttcctttgcatatatacctagaagtgtgattgtcagagcatataagtccatttttagttttttgaggtagtgccctactattttccattaataggtgtaccattttgcatttctgccagcagtacacgagggttccaatttctttgacttcttcagatttttgtgaggacatgggttctaggttaaaagatctggaagtcttctcgtaattagaaatcaaagtcatctagaaagtataatttgtttttttacctctgggaaagacagtttaattttttcttggttttgtctaacttttatgtcaactagcaatttatgaagatgtactttagacccagtatggggaaagctaactaattatgttttggaacaaccacttgttctcagccttccatttagaaacaggattcttttttttttttttttttttgagacagtgtctcactctgtcgcctagactagagtgcagtggcgcaatctcagctcactacaacctctgcctcctgggttcagttcaagcaattcttgtgcctcagcctcctgagtagctgggattacaggcatgtgccaccatgcccagctaattttgtatttttagtagagatggggtttcactatgttggccaggctggttttgaactcctgacctcaggtcatctgcccgccttggcctcccaaagtgctgggattacaggtgtgagctaccacacctggccgagaaacaggattctaagtgtggactggggaagtgcatcattcatgagatgggaggtagtggggagatgggacgagcagtgtagtgtactctgccttgtgccctggagtggtgattgctggtgactgtttccaggcgttccagcagcccccagcgtgctttgctggtctagttgtgccttgggcttcccagctgagatgaacccttttgagaaggaagccacttcatagaaggggtcaggagcagagaaacagcagaaggggcacaagccgctcattccctgtcccctctcggacttcctgccaggattccagatgttcccacaggagggtagggagcaggtgcggagctgacctgcccttagtgatggggccagtcttgaccttggcttatagtcagagtcccctatatttcagctgcagagggcagtaacacctccttttttggagtccttcaaggctactattcatctgggttacatatgggacttcacatttggctgagtgaaatatttttattttataaacttcatttttttgtttttatttttctgagagagggtcttgtgctgtcaccctggctggaatgcagtggcgtgaacttggctcactgcagccttgacctcccagctttaagcaatcctcctgagtagctggaccacaggcacataccaccatgcctggctaattgtttaattttttgtagagatggggttttgccatgctgcccaggcttatatactatacactttaaaaattaagctctagaaaaaatatgatcttagtcttcagtgtggtgcaaggaaagtatcagaaaatgtctttcacttcttgttggcacattatatggttgaaaccaaacatgctttttgttttacaggaaacttcggctgttctcaggaaattctaagcatcgctgccatgatgcagatccagaatatctttgtggtccccccaaaccagaagtctcacgcagtaagtcagctctgtccccaggctgtctgtaccagtctcttttgctttgagctttcgttgtcaaaactgtactcaggaactgctgaagacagagctgtacaaatgtgatctgctcatgttttgagtgtttattccgtgcttgatgttgtgtcaggtgttttgcaggcatcattccactttatcttcattataagcctgggaagtagatattattatcatattttatttatttatttatttattgagaggaagtctcgctctgttgctcaggctggaatgcagtggcgtgatctcagcccactgcaactgcactctgcctcccaggttcaagtgatgctcctgcctcccatgtagctaggattacaagcgtgctccaccacgcccggctaatttttgtatttttagtagagatggggtttcaccatattggccaggccggtctcgaactcctgacctcaggtgatccgcccttgacctcccaaagtgctggtattacaagcgtgagccaccgtgcccggcctattatcatattttaaagatggaggcatagagaggttaggtaactcattcacagttgcacagccagaattgttggctctggattcacagtccagagccccacaccttaaccattgaactaccaacttctagtttctgtcagggaaattgtcattcagactgctctgctagaaaccttggtgggcacattagtgacataagaagtcaggtgccagggtatagcaggctgattctgggcaccacacgacatcatggtcatgttgcaggtgggccattataagctagagagatccaatccccacctaaggtgcaggcatcagcaatgactaattgagtgaacactggaaagacggaaggacaagttttgatactgaagagatagatactcagaagtaaggtgtgttgatagaggtaggtcagagatgagttcaaagtcagttcctgtttgaaagtcagagaattagcagccttatgcatggaggggctgaatttgtatgtgtaatgaggaggagagagactttcttagggattgttgggatcctccttgtcagttgtataactatagattacaaagtttttctgcctctgtgcccagatgcttatgtctgtttttgtttagttttgtttttaattaacctggaggaggagagagacaagaacactaacattttatcaaatttctttgccagataccttgtaataaattatcttaatccacagcaatcttgataggtttagtttcctgattttacagataaggaaatcaaggctgagagaggttaagtaaccaagctgagttctttcaagatatggcagagctagaatgctgcaaactaggtctttctgaatccataacccacacgctattcaccatgcaatattacttccagtgcaaaagtcaatttctttctttctttctttttttcttttttgagacagggtctcgccctgttgccttggttggagcgcagtggtgcaaacatggctcctgggctcaagcgatccttccacctcagcctagtagctggggcttagaggcatacaccaccatgccctgctgatttttttttttagcttttgtagacatggggtttacctatgttgcccaggctggtctcgaacttctgggttcaggcaatcctcccaccttagcctcaccaaatgctgggattataggtgtgagccaccacacccagcaaagagtgaaattctgaatgttgcttcattctttccagattcgagtgcaccgtaaatttgctgtggaggagggcgaccacctcactatgctcaatatatatgaagcatttatcaaagtaagcacaactactgctcgaagtgccgcctcaacacaccaccctctggaggtgatctaggagggaggatcccagaagttcagttcgtaaaggaatgtccaagagagcccttgattttcctgttagatttattgccagtacttctaactggtgggtcgggctttctgcctgagtttgtggtgaggtattgctgagaagaacacaggaatcattcattgctttcccttgcttggagatatggtacactagtggcaggccagtggcccagcctcacgtcatctcacatccactgtgcagtagacagaaaggcaacatttgaataggaagttctgttacattttctgccaggtgaatgaggctgagagcaacttgtagtcctgggttgaatcttcaaagctgtcccagctgccatgagaagacatttagttgagatctgtgcatattcacatatcccacccatatttagctataagtgatgttaattttttattgttaatattctttaaaactaagcaaataatacagcttaaagttctcatgaaaaattgttaataaaggtgatgaaaatgatgaaaaaagtaaccttacataaaagaaagggtataatacttcagatttttaatactcatttcttaaatactcttttagaagtgaagaaatactaaatttttgtttaccagtgatttgaggaagattattcagttggtgaaaagttttcagaaaaaagaaattcactctttttgagacttacggcttaaatcagttaaaattcatttgtacaggcacaatgtatcatctgcagtctgaagctttctctaccactagaaagtgggtataggtctacattgtattattctatggttgccttcttggaatatcttctattaattacattttcttttttaaagcactttaacttacaatagaatttcagaggtacatttccacagcaataatttactctaagacataatgatcatacttatgaatgcagaaaaaattaaatactgttgatagaaaaatcatgctttggggacaaataatagtaatttgtaaattatttctacattggcaagtgtcatattgttggcttctagtataataaagtgatacattcaagcatgccaaagaagaaaagttgatttacaaagaaccacgtggagaaatggttctttctgatagttcacatctcatgaaggtatgtaagattgaaaccgtttctgcgtgtcattaagttctcatttgccctttagtgtaaagagtgaggttgcagagcagtcagatgtgtgcaaggttgttaacatctgttttgagagatggggcaaaaaagggccagttcccatctttagatcttatgccgttgaacagcacatgggggaagagagaagaatgatctttacaacatagccttagtcgagaacatatctgttttctaactccctctctctgggttgttctgtagcacaataaggactctaaatggtgtcaggaacatttcctgaattacaagggtcttgtcagagctgcgactgtaagagaacaattgaaaaagcttcttgtcaagtttcaagtgcccaggaagtctagtgaaggtgagaagaaaccgtcccagctggtgacctcccttgcttcattctgttgagttgtcttcctaaagttctcatgctgggctggtgcgaggcagtgtggcgtgctctgtaccaacactgggttttatattttgagttgcctgcatctgtgaaaagctgaaggtcaagttgcgtattttttccaaggaggtctatttttctttctgatgggcattcttactaaaggaatttcatagcccatgacaatacttaagaatcactaacagtcacatcagtgcacatcatgtcattgattttcccatgtaggctttgcaagaaaaattactttttgatcagtgatattagtagctattacataaaaattaaattttatattcaaagacaagtattattaaagcaagtgctggatatttagcctaggcagccactaaaggtaagacagaaaagtactatgtaagacgtagtctctggcctctagcagtgacagtgactactattaatcagggacacagtaggttacgctgtggcaggggttctccaaatattctcttgctcaatctcgcactctgtgaggtgtcggtaatgttatcctcattttacaattagtcgtaagatcctagggagaaggtagattaaattcaggaccacgcaactggtaaggaggagagccagatctgtatgtggctcagaagtctacgcttttaaggaagtgacacacccgcctcagcagtcagcctgaaagcctagtgtgccaggtactcagccacatcctcagcaccattagtacttggtaacatttcctgagtgcttataagtggctagacagtgcactgagtgttccatgtgtttattaatttaatgctcacaacaacgctgtgaaacgtgtgctcttttccccatcttataggtgagaaaagcgtggctaagaggtaaaatgtaacttgctgaagttacacagtgagggtatgatggagtcagaacctgagcccaggcggttccatttaagtcttcttttgtctttatactaagagcaagtgattaaacaatgacggagtcttggcttttactctaagggaacagtgtaatgaagggagagattcatatggatagacaaagtactaagattatcagtcctcttcgaagttaaagtagtagatactttagtaatcatagaagacgtgctggcagatgtggaaggaatgccgggaagaaggaatccagagagggctagcttgggaagtctttcagcttccttgaggtgtggtgggagtccggtcaagctttggggtctggttgaattagaaaatggtggcaaagagcactctagggaaggaggactggagacaagtgcttggagtgaggagtatatgagacgctcagagaatatttgatgggtgaatacactcacgagagagggaagagttgaaacctgggccattgagccatgttggagtcattgatagaaacaggatgcttacaaggagcacctagttggagagcagctcgtcaaacgcctgtcacccagcaggtagatgacagccttacttcagcaattggtgttcttcacctgtgtttcattatcagacccctgcccaggagaaaagttaaatttaaattctacccagcctgagaaattaaatactaaggaataagattttgtagggtaggattgagctttggagggctaccggccattgtagtgtctaagatgctcccctccccctgcctccaagaaccagtttccacccctttggaagtgatatcacccctgtttagagtgcatattttacatggaaatttcttatggacaataggagagaagagactggatatcggattagatcatatttagacatgtagatttgagattttatcagctcagtgcttaggaaaaatacagaaaatcatggagactaaataaattacatgcaaatttaaaacatctaagggttaaaaaatagaaagcaattagtgaaagatactttcagcagtcatgagataaatgataaagattaaaaactttattatagaatgattttatttaatatatttaggaaaaaacagttttcaggttgataaatgggctaaggattagaacaaaaaattcacaaaagaagaaatatgccgatagtaatcaaataaatgtaatataaaagaaggtaacagaaggtaacactttttgccaaaacattgctagtaagaatgcagtgaaactgccatttttatatattgttgatggctttggaaatagtaccacctttatggaacttacttaccaacatgctttattccattggatctaagataccatcatgtgtaagaaacatcgttattttatgtgtcaccaaagaaaaaaaatgctgccagttatcattgtaaaatgctgtcctaatttcagtgaattaaagttagaaaaagagcgagtcttaaaattgatgagatgtgatatgtcattaaccataaaaataacattagccttttgcacaacaatttggaatgtatcctatggacatcatctaatagtggggaagctttattcatggaagatgttagctgtagcaatagaaacaccagttaaaatggaacatttgaaaaatttgaagaattacttcaattttcaaacactagctcataaccacagaagtaacgttgtatactatctccagtttgtgttttatagaaagaacattgttgccatatgacactcttttacaaaggagttctgaggtcactgaccagcctgcagagcagcactcttaggttctggtgcccagccatggtccagtcatctgtggcttaggggaggttggaggggtcccaggttcaaggagcagaccagcattgttgtcagcagcagttgtggggagtgggacctccttagatggtgctggggcaggcatccagcattgggaagggtagggctggagccatttcaggagagggtttccaggtgtcttgaagcagcctggggtggtgctgggagtggatcctgtgcattagagcacacggagcctagggcaggcaagggtttcacccgcctctctgttggctgcctatgtaggtgacccggatctggttctgaggtgcattgtctccggcttcttcgccaatgcagcgaggtttcattctactggagcttataggtaacatgatacttggtgaagtcatttgttaaaggaacaatcttacaaatgacccaaaccccacagaaagctgtgcagagatagtaattgcataattatttgtaatttctaccatgtctccttccaaaactgagttgaggttagcgacatagctttaagcaaaatatcttgactttctaaaaatgattctcacatattcagctcatctatatgttgtatgttttagaaggatgacaattatacatcttgaggctggtaatatttcaattctaatgacagaataatatgacctgaagaaactattaaaaataatgtttctcagagaagttattttacaattggctagtttattatgtctttagagatctgcacgactgaagtcccctcccaccctggtatagtgtggccacgtctggtgtctttggaggtagccaggtgtttctcatgtgctggatgtgcctcctgctacataacctgattcttccagttccattttctaggcataggaaatcactcattgatgccttcctaatggtctttactatattcaaatgcagtgaaaactaagcatagcttaggcatactgtagcctgtcagtatcatgattctccaaactaatcattccagtgctttgaattgttacttttattctgtcttttctgtctttggctcattttagtttcataacctcagtgtagcctcctaaaagtgtagctatcatcattttctgttctttaataagagaacactccaaagaatttctccccagctcttctatgtattattttgtcattaattttttttcccagagaaaatattactgccctgttatcttgaggtcagccaagatatcccttgtcctgggctcctgttaatgagtccagagttgcactgagccttttttaattttgacagccagatctgctccatctagtatcctagtagccgactgttggaactgcaggatagcactttacaatgatctctagtatgttctctttgttactccaggcatgttgtagcctgtcagtattgtgattcatttgcccattgtatgagctcacctccccaccctgagttgtctgtatttgaggcaacttgtccatgtggaggcgacccccacggtggcccgagatcttccctaaggagtgctgccagcttgtcatcttgattgctcctactctcctggagagttagcaattttgactagcgtttggaaaattcttttatcagtgtccttagcaacaatgtgggctacctaagaggttccaggctaatcattcctttgagacaacatttagtgttgatcagctcaccaccccctggtaggacagcccaggaccccaggacgctggctttattacaatgccgacgaggcattccgtcacagcacttgaagcacttcccccaagaaacagatcattctactgagttggaattggaagtactatttcagagaaattaatagtccagtattgagcttttttttttttttttgagatggagtttcgctcttgttgcccatgctagagtgcaatggggtgatcttggctcatcgcaacctttgcctcccagtttcaagcgattctcctgcctcagcctccggagtagctgggattacaggcatgtgacaccacacccaactaattttgtatttttagtagagacagggtttctccatgttggccaggctggtcttgaactcccgacctcaagtgatctgctcgccttggcctcccaaagtgctgggattacaggcatgagccaccatgcctggctgtgagctttcttttttcattatcgttacgtccccctatagtcattatctttagtatttaactttgctttttagattatagaagaaatcacatgtattatttccattccaaaggaaattgttttgaaagagcacctgcagaagatacacataaacataggcagagcattttattcctaaatgttttttctaagtgtccgcgtgttgcttttctcctcttcgctttttccacgtgatttattcttgacttctggggtggcagccaggagagggatcaagaaaggttgcaagagaagatggagataattgttttgcttgtgacgagttcagtctgcatgcttttttggtaatattaaaaatatctgtgggaaagtcttgctataagtatttaaaatgtgcttcagacaaaattcttctatgttccaaggaccatccgtgatgaccatgagctgcacatacaccctgcgtcagtcctctatgcagagaagccgcctcgctggtaagctcatcctgctgcttagcctgtgcctgctttgaacagggccatgttcttgtttttctcctgtacatgtttcttgacatcgcctctagaattgctgctctgggccgggcgtggtggctcacgcctgtaatcccagcactttgggaggccaatgtaggcaggtcacctgaggtcaggagttcaagaccagcctggccaacatggtgaaacctcatctctactaaaaatacaaaaattagccaggcgtgatgggcacgtctgtaatctgagctactcgggaggctgaggcaggagaattgcttgaacctgggaggcagaggttgcagtgagctgagatcacaccactgcactctagcctgggtgacagagtgagattccatgtcaaaaaaaaaaaagagaatttctgctctggcaaagagcttcttaagcaaacagtgatatttgtctactcactcatccactcagcaaacgttcattttcaaccactgactggatgcttagccctgcatgaggcacagctatgcagagatgaattgggatcccagctcacggttcttttttttttttttttttgagacagagtttcgctctgtcgcccaggctggagtgcagtgacggcgctatcttggctcactgcaacctctgcctcccaggtccacgtgattctcctgcctcagccacctgagtagctgagactatagatgtgtgcaatcacgcctggctaatttttgtatttttagtggagatggggtttcactgtgttggccaggctggtctccaactcctgacctcaggtgatccacccacctcggcctcccaaagctctgggattacaggcatgagccactgtacccggccccagcccacagttttgacatagggacagacacagagtcaactaccttaggggaagggctttactagcagcatggatgaagtgctgggctcagcacatcatgtgccagtgagagtcagggcaggcttcatggaggagataacattcattctgaacctggaaacaagagtgttcagtcagaaaggacccggagggtattctaggtagagaagtagcaggggcagagccatggaacataaaggaacctcatgcgtttgggaagtggggaatcattggtatgggtggcccatgcaatggtgctgctctgtaacactgcctaggaagaaagaggtaagcacagaagtctagagtaggcctttagacatctttataacatttcaatggttaagtttatgtttgtccaatttaataataaaaattgggggcttatatttttcttgtttacaatttcatttttctagaattcatttatattgtattttaccaataaaaagtactgattaaaagtactgatcaaccatggattggattttgtttttttgagacagtgtctcactctgtgtttttgagacagtgtctcaatctgttgcccagtggtgtgatcttggctcacttcaatctccaccttcggggttcaagtgattctcctgcctcagcctcctgagtagctgggattacaggtgcatgcaaccatgcccagctaatttttgtatttttagtagagacggggttttgccgtgttggccaggctggtctcaaactcctgacctcaggtgatctgcccacctcagcctcccaaagtgctgggattacaggcgtgagccactgtgcctggcccagattggaaattttaaagacgacaacaacttgtccttctccaattggaagatggagaagccctgggaaaaagggtggggtgtgtgtgaagagagggagagaagatagcggtagatttgaaggcaagaaagtctgtggtcaaacactttgtaccctagaattgcagctttcaaaatgtggtctccagcccagcatcagtatcacctggaaacttgtacgaaatgcagcttctcaggccatgccaagtcccattcaatcagaaactggactagggcctaggactccattttaacaagccctccagatgtttcttttgggcagtaaagtttgagttctgtttccctagaccaaggaatcggatttatcctgtagccactgcagacctagaagttgcttaggttgaaagcaccttggtcggttctgggtttagaaatgttacccagtgaccacactaatgtggtcaggatacgcacactcgtgtgcaggataatttgaagagtgcccacgcctgtcatctcagcacttttgagaggctgaggccagaggattgcttgaggtcaggagttcaataccagcctgggtgccatagccagacctcaactctcaaaaaaaaaatgagccaggcatggtggcacgtggctgtagtactagctactcaggagactgagacaggaggatcgcttgagcccaggagattcaggcttcagtgagccatgattgcaccactgcactctagcctgggtgacagagcgagaccctgcctttaaaaaatttttttttttaaatcaagagagatgcaaaacctcaattttagatcctttttttgctgacttttgggtggttaaatttgggagttgcttaaaggagaaaggcttttctttttcttgcttcattcctaaggagctctgaagggcaaagaaaggttggggaaatagagccagcctgaagccatgccataccattcaggtggcaaagaaagtgccccccagtcacggcctctttgcagggggggcccttctttttcctttgatcagctgagattcacttactggtttttgaggggtggggaaccacagtatggctggtatgtttataacatgggaagccctgaattaacactttggatgtttcagaaactgatatctactcatatgcacacctaaaatcaggggactggatgttatgctcttggctcttcggttgtctattacctgagccttagaaacattttttcccttaaataaaggtataatttatttacagtgcaagatgagttttgacaaatgtgtatacccatgtaacctggacccacataaattatacaatattgttatcattttagaaaattcctttgtgtctctttacagtcagttcccagcctctttcagaatcaggcaagtctttgcctccatttctgcattttctaataaagtcattaggctcagttcagagttctgtaaatgcagatgaaggatccagaaaggtccttcgcggataactgagatgttccagaagtcattgaggatttagagtctcatctgaaaaatggacacaccattacccagcacttaggtcttgaggctgtggtgagcaacataaatgcatgtgtttagcacagtgtctggcacatagagtagaacctgttaaaggttaaaggaaacagcatgtctacctgtggttcctgactgtcatcacaagagggggaaattagctcatgtttctttctcatttcagggtcatctataacgaagttatacagacctccaagtactacatgagagatgtgactgccattgaatcggcctggctgttggagctggctccacacttttatcaacaaggaacggtaggaatgaactgagtctgtgccccagccacctgttcacagcctctccatgtttttaaatgtactttttttctccaatttaatgccctatgtgtgttccccctaggggtgcatagggtggaaaggccattaccatatccccaaaacattctgggaaagcactctagcgtttaattcatagtgaagtgcaattaaaaataaatccccctaatctcataagaaaaaaaaggtatcgctttctcgctttctttctccttttgctcttccaaactatttttttttttttttttgagacagtctcactctgccgcccaggctggagtgcagtggcacgatcatggctcactgcaagctccgtttcccggattcaagcaattctcctgccttagcccccatgtagctgggattacaggtgtgtgccaccacgtctggctcatttttttctttttcttttttcttttttttttttttgtatttttaatagagacaacggtttcaccatgttggccaggctggttacaaactcctggcctcaagtgatccacccacctcagcctcccaaagtgctgggattacaggtatgagccagcaggcctggcctgagctaattaaaaaaaatttttttagggatggggtttcactatgttgcccaggctagtctcgaataactgggctcaagtggtgctcctgccttggtctcccaaattgctgggattacaggtgtgagccaccatgccaccagttcgttttttatttttatttatttatttttgggacagagtcttgccctgtcatcctggctggaatgcagtggcacaatctcagctcactgcaacctctgcttcccaggttcaagtgatactcctgcctcagcctctctaatagctgggattacaggcgtgcgccaccatgcccggctaatttttgtatttttagtagagacagggttttgccatattggccaggctggtcttgaactcctgacctctggtgatccgcccgccttggtctcccaaagtgttgggattacaggtgtgagccaccacgcccagctccttttttaaaagggttacagccctgtgctgtttgtggcctgaaaatacttgctttacatattttgcccaagtttactgttgtttacagcagaagagaaagtctgaaacctttttctccattagggccagaattggactacacaatgtttccaaagcgatatttgaattgattgccacattgaaaaattgggagatttcatattaaacatgaatttctggtttctcttgaaagacatgtttagtctggcaacactaggcttgcgttcctacgtggtggcatcacaggggcttaggggtggctgcctgctgttagtgacatcgccaggtgccgtagtcccatgtcacttgcttacttgcctgctgcactcttggagacatttgaatttgtgaccctgtaaatggaaggatctcctcatctctcctgctccagcaaagtcaagggacattgccctctcaaaattttataatatttaatttttatgtaatcaaacaaaaaccatttcacacctttatagttcttcacacatcccaattcagatatttcagctggaaagcagatcagcctgcagggactgataaaaatgcagtgtgtgttgtctttgctgaattaggttgataagaataaacctggtgaaagaaaggcttttccttcaaaacctctcaggtggaaagcagcagacttcaggagtcaagagaagggatcagaaaggtaaactagaggttgaaagaggaatggtgcagtggtcaaaatgcctgttaaagtaagaagatgcagacagccagagaaggataagcctgaaattgtcttggattcatttagactcttggaaacagaattagcccagaagctgagtcattttcccttctcagctcaaaattccagtttctttaggtcaaacccacaaagttaaagagcaaatagcttcagaaatttgaagaaaataacaagcccaaatttcttcatttgtctcttctctccaaatggcttttttatttttaagctcatcacctccactgtcatcggagtatttttagagaggctgggacagacctttagaaatcacctagtgcggccgagcacggtggctcacgcctgtaatcccagcactttgggaggctgaggtgggtggaacacatgaggacaggagttcgagaccagcctggccaacatggtgaaaccccgtctctactaaaaatacaaaaattagccgggcatggtggcatgtgcctgtaatcccagctacttgggaggctgaggcaggagaatcacttgaacctaggaggtggaggctgcagtgagccgagatcacaccactgcactccagcctaggcgacagagcaagactgtccccccaaaaaaaaaaaaaaaaaaaaaaaaaagaaatcacctaatacaacaacctcattgtataacgatggtccccaaaccacagagaaacttgtgttgtttcttaactgtatagtccaagggcacttctactattaacttgtccaaagcagattgatttctcaaagaacctccagatctacaggggttgcccatgtatggtagatgttcctttactgaacacagtgcagcacctcacaaccttccacagcccacagatcattcacggctctgttcctggcacctttggagactttccatcaccactgtttttcggaatgttgctctcaccctgtgtggaggcctgaaatggttcagagtcagctttgtttatattcaacattcttcccagaaaaaagcaccaaaaatggccccacaggcacaatggcgtcatctcccatccccaagctaaggccgtggatatctaacattagctgtaggggttatatcaggtgacgtgtagagagagaattcagagaaattcagcaagacctacagctagacaggggaagaacggggtgacctattcagagatttgccttctggcttttaaattatttttccttattctcagagatatcttcattattagggaaaacccttttaacgaggcctttgcaagagcctgtagtagtcctccctcaggtgtaagcagatggaaagtctgagttcttgtagctcatttatacccgggtcctgttcgctctgttgtctctcacgtcatacctggtggtgcgctgtgtcttcgttcacgccctccattttttcagggcctgcagttctctctgggggcgatgcggcttgatgttgtggggccatgtggctgtgctaagtagtgggcacaccagctccggagcagtcagggtgggcattctcatgtgaggctcccactgtgtgttagttggcacggcttagggatctcttggttattgatgattagtaatgggctgtcgggtatatcccagttgatgagtggagggaggtctttcattaaaagcttgtatttacacactctgcctcaaaggcatatttaaggatttctgccacttttggctttgctttagaatgtaaaaaatacttcattttccaatcctattatctgatgcctatgattagaatattgtgcttcgtgttattcataatggtagaaagtgacatttctggggaaaaaaaaaagtgtcactaggaggtgtcctttctgttttcccagcaagcttgtaccctccatgtgggcagaggccatatctttatctccatccttgagcatgggtacctggtgtgttgagacgcttggtaaattgacttccttggtcctaaagagaggataatttttcttgactattgtcaggaacttcttggagatttgagatcacttccagactgagcccagtctcctgagcacagttgtctggctgcggtgctgtcctctaggctggggcagagggagagtcgtgtctcaaaaagaaaacctttccttgacagcttccgcagagccctgtataaccagcttcagccgctgtggcttgggcctcgggttgctggcggctgaattcaggtcggcttcttcattggccacttgggctttttccttccaggctgtttcatgaacagctcagcatttactgggaaggtgtggaccagatggaagatttgatgtggtcattcatatggggattatgttgcagtctggtttctttgtctaatcaaccccaactgtagtgtcttctcttctgttgcagcacctgtctctgaaagccaaaagggccaaggtccaggacccgtgagaggagcccacagctacagctgcagggactgctggcgtcctctcctccatgctgctgcccctggtcccaggtggggtgagctggcaccagctcctgtggaatgtttggttgctctgaagtgggctgcggcctgttcattagtcctttcttcccgctgcccacagcatttgcatccttgctgggatcctggaggactttgtgcatgggcaggcatccttctgtgctgcagcgggcagagtgggagttggctcactcagcacgctcactaacccagcatgccacttccagcaggcatgcagtcctggcccagctctatgggaaacaaggaggaaagttagccactgaaggccaaaacaccatgtggggtggacagagggtttgctgggctggctttgctttccctgctggggccacagctgtgttaaccaatgaggtctgctgccaggtgtgaacaagcatgtctctacgaatgaacgaaacattggggatctctgccgaaaccaccaaagggcatgtctgatgggcacagggtctcccaaacccagtggcttctgtctgtcctcagcccttgtccctgtttatctgcagccaggagacttgcaagggattggtgattgacagagaggactcgtgcgctgttttgtgttagcagaggatttgtgtttcacaggtaggcttagcgtcctctcagagtgtagtgccaggtcctggtgccacgctagctgagcactcaggagagttcatcagctcagatcccacagggcctcctctttagcaggaattcacaacagtttggatgccctaaacttctgtagctcaggaacatcactggtgtatttgtttttttgtttgtttgcttgggttcttgcaagagcgcgtggggacagttcttccagcaggcactggttttgttgccccagggctgctttgctgtgatgatgattgcatttcaacacatgccagatgcagattttttcccccttactgtttcaatgacctttattttaaaaacacatagcttgaaaatttatttttatactgatattagtttggatgtgccacttttggcaccaaacgtgtatgtcatttttatttccattttataaacatgtaaataatagtgataacttgttaataatagtaaacctttatacctaaagtaaatgtcttccctcccacacctggttttcgtgtctgtatgttaagatgttctaatgaattgttcgaagtgagggcctgacattagctaagaaacttaatgctgtggcatacagcagctttgggatctcagggacacaggaagccccctaaagcaagatgatgtgactgaatgacctcaagacctgattagagtaaactgtgggacatttaaaagaagtcccaaagaggtgctaattcttgccagtttccagttgggatcttcctgtagagaggtcagaaacattatttttcaagtttggctttaggactggggctgatcctaaaaagcttatatggcggtggaaggggaaaggtacaggtttcacaccctcgggttggagaccagagtccactgggagcccggacaatctggagggagcacccagaggcaagcccgtccctgcatgctgcctctacccctgggcgcctgatcctgagcacatgcttcccctctgtccctccacctctcagaaggcagccctccccaggcgacaccccccagtgttgtgtcctgtgttatgtcacagtctgtgatgggtgggacaggtccttgctgtccgaagcaactacaaaatcctgggcccatggggaggcccctttacagtagggttggttaaggctgggaccacacaactcaccagggagtggggcccggcctgggcgagagagatgagagcttttgactttgtctgttgcaggtctgtgtccctgttcccattgtcagcccacagatgtgacagcagggcctagtacctcacagactgtcccccagtacttccacagaattagtcccctcgggctccacacaggtcttcagatactgctagtaaaattccccacagcattgctgtgtcttccctttggagcaagtgagagggcagagagaagctggcgctggaaagcatggaggcggtggtgccctgtaggcccagagatggcagctttctgtgttggtggcttgcagagaccctgccagttttctgccatagctggcttccccgggggttggacattgtcgtcacagggagcccctggttcagccagtgcgctgctcagtccagccagcaaatgttgagccctcaggccatgtgcatggcacagggatgaggcggagacacttgacaacaagtaaccagatgagtggaccaggatggagctgggcgcacgagaaggacagggtggcaggagatggcagaggtccagtaggggttgttaaggccagggctgtatccacagagacttccccacgacaagatgctttcctggtgaaaggacagaccgctctcatgttcttccctggccatccccacattgctgagcatttcatgtgggccatgaacttggagagctgcctagtgccccagctccatgctcccatctccactgttttgtcctggtgtcagcacagcctactgccagtgctgctccagcttcatgggctgggccctgccattcagtgctgggttgtccccagcaccccagccctgccctcagctctgttttccagggcccggcgctgacagtgtggctgacatttctcctagcctgagcaagaatgtctgccgctgaccagacagagggttgggtggctgggggagggaggcgcaggccaaggggcctaaatctggaaaaccgcaagactccgtcctggagccacaagactggatgtctggcagtgaggcctgggaagctgtaagttgtaaaagccccatctcgggtggttctgatgaagtggtgggcttgggaatcctggggacaggagttgaagatgtgaagacatgcagcccaatggacagatagcccccagcggggagatcagagcttcgagatcagagcgtcaggtctgagtgaaagctgataaattgtttcttcacaagtgtgcttagaccccagcccaattccccttacgtgtttccccagaacacagatctgtggggttgggattcttccccaggcaggttgtggcagcaggcatcaatgtcagctcactatgaattttcctgagtcttgcaaaaatgaggaatgtgtagtaatgagcattttataaagcttaagtttattctctataaaagaccatcctttagtgttttttattttttatttttattttttgagtcagagtcttgctctgtcacccaggctagagtgcagtggcatgatctcggctcactgcaacctccgcttcccgggttcaagcgattctcctgcctcagtctcccaagtagctgggattacaggcacctgccaccacacccagctaatttttgtattttcagtggagacagggtttcattgtgttggccaggctggtctcaaactcctgacctcaagtgatctgcctgctttggcctcccaaagtgctgggattacaggcatgagccaccttgcccggccatcctttagtcttttcttggtgctaagatgcttttaggaaacaatggtgatagtagatggtggttttattttttaatgttttctttggaaaaataaaatgtcaacagtcgttcatctatcacccaattaaaaaccaattcaaaatgatgaaacaaaaactgatgtaatcctcaagtctgggaactactgggttgtggctgagtgggccgggcagggcatctggcagcatcagcaccaagatcatcattctgggaagtggatctgaactgccaagcacccacctgggtttcaagtgaactttggcgccgctggaggacatttctatcccctggaagaattcgagttggcaagtctcagccccatatccctttttcacctcaagataagatcaggtattttccactctccaatgattcatctgaattttctcctcagccttctaatttgtgatgaaacaggatgatggaactctggatttcttgtcagtttaatctgtttttttttttctttttttctgagtcattggaactggaaatagccaatcaaataattgcacaaacagctggctactgtggatgaccaggtggaatttgcgtggcagacggtctggagagggcttgtccctgggtcctcacagtcattgctccctccagcaagcaaggatgacacgttgacgtctctggtgaatcctggcagtgttcccttttgcactcttgggtggcattggacttgctggaacagggcgtctccttgcctgcttaagtgcggccaaagagattcccagcgcagcgttcccccaggccctctggcacacatggccaccgctcccacttgtgggttctcctgaaggcaatgagcaggctagggaggctgggaggttcacaagggaggggtggtgcaggcacaggatttaataccccaggatctccatagccaggtgaacgaccagcacaggctactgcccatggcttcttgaccatggcctcatcagtggctccaagtatgaacgtcctagccaggttctttgctggcctcagcctgatgggcggacccatataggacccaaaggtcgcctgagttcctttctgcgtccccaccactgccatcagcctctacatcgccctggaccccaggagagcaggagctggctgataaggccttaccagctcaccctcaggctgtttattttagcctcgttctctggttgcttttcttccccgcattttaggcttgttctgttttcaagtgcggtcttcagtttgcttggtgtctgctgtccctgtgttttccctttgctgttgtttttttgtttttcctcatgggtatgcctcacccctttaatctccacctctctgacctctgcattattttcctttttactgcgaagttttaaaaagaatgcagtcgtgtttatttttaatgctcttcaaaagtattttttcctcgacatttatgttaacgtcttggtcttttttgtactctgcttgtttgtctaactattattttggacatttgttgtcgtggttctataaatattttcttctgtgatcttcttttgtttctttttgttttgttttgatacagagtctcgctctgtcacccaggctggagtgcagtggtgcaatatgggctcactgctgcctcggcctcctgggctcaagtgatcctcccatctcagcctccccggtagctagtaaagacggggtttcttaatgttgcacaggctggtctcgaactcctgagctctagtgatccacctacctcggcctcccaaagtgctgggattacaggtgtgagccactgtgtctggccttttctgtgattttcatcttctactttagtgtattagtttaaaactcaacagttgacttcccattttattttacttcctttgccccccttctcttcatttctttttttttttttttttttgagacagagtctcgctctgttgcccaggctggagtgcagtggcatgatctgggctcactgcaagctccgcctcccgggttcacgccattctcctgcctcagcctcctgagtagctgggactacaggcacccgccaccgtgcctgcctaatgttttgtattttttagtagagatggggtttcaccgtggtcttgatctcctgacctcgtgatccgcccgccttggcctcccaaagtgctgggattacaggcgtgagccaccgcacccggcctcttcatttcttattatgcttaatttgctttagtggttggcaaaaggcctacctgtaggtgtgggagctgggggaaggtattccaaacaaaggattaaatgtcaggaatgtacaaggagctcctataaatcaccagtgaaaagacaactccagcagaaaaaaatgggcacagggaatggaaggcaatgtataggggcagacccaacactccaccaaaccactgaagagatattcaaagttagtcatcaggaaaacacaagctaaagcaacaattagacatcactctgcaccaatgagattagcaacacagtggaaaggtggcggatggagatgcggcggcctctgtgcgcagctggtacggcagtcctggagagccacctgggactactcatgtgtgttcctgccccacagcccagaaactctgcttctgggggtgtgttcccaacaaaattctcacccgggtccttaggagacacatgtaaggatgcttactggtgtgatggatggggtggggactaatgtccatccctgggaggtgtgcagggacaatgtattggatgacactgtggatcagtacagagcaggttcatagaacacagacctgagaaatagctgagtggaagaattaagaaactgctgtaatcccagcactttgggaggccgaggtgggcaaatcacaaggtcaagagattgagaccatcctggccaacatggtgaaaccctgtctctactaaaagtacaaaaactagctggatgtggtggtgtgcacctgtagtcccagctacgcgggaggctgaggcaggagaatcacttgaacctgggaggctgaggttgcagtgagccaagatcgtgccactgcactccagcctggcgacagggcgagagtctgtctcaaaaaaaaaaaaaaaaaaagaaagaaaaaaaaaaagaaactgatgtgatagtcctgttcacggagactaaaactacatgcacacaaaaccaatacgattgcaaaaatatgtacaaacaagatgtgcatcgcaagtgttgcctgtgggggtgggggtaggacacaaggattggcaataaaataaaatgtaaaatgaagtaagatggggataaggagcctcaagtgttcatctggaggagatgtggattttaggacacatagcccttcttgtctaaggttttagacctgctcaccagtggccccgggaggcaggaggttgtggagttggcttcagaagcctgcctcccacctccaagctcatattctggcaggaaccacttctaccctggatggagtgagtcggccaacaacatgagacattttgatgctttttttccctatcacagcgcatttttactcagatacatgatctccttgggacacccttttaactcgtgtttattctacatgccccatggtacagttaattttcatcggcaatctgaaagccagcaacagccgcagagcttgtctaatcaccaaggagtcaaagacatgcagccccgcggcccctttcagtagaggtgaaggaactcactggaaaagccctccccagtttatgattaaataggctactaaaatggagggtagcttataggatttatctgggcagagcgccttcatacttccagggcaggaaccagtaggacagacagtgtcatttaagtccttcctgctgatcagtatccttaggttggaatttatgctctcagcccatagggactcttgttccctccacttcggcacttggcactctgcttctgagcctttggccttcaggaggcgaaagagaactggatacaccaaggctttgaagatcctgatgagcttttgccatccgaggagcatgtagacttgagctgtgtttgctacacccagatgtggctccctcctctctcttgggcttactgatcatttagaaccagtttaattagcactggtgtctgcttttccaaagattgcctggtaggaggcagaaatctgggccaggttagtgaggcagcatgcaaactggaagagaccaccagggaacttgtacaatgtaagtcttactccaagctttccattgcttggagaagggtgttctaaatcacccttggtcttcccgacttcagttgcagactcagaaggagggcagattctggggcgatttcttgacccagtggtgatggggtcgtgggaactcagcttctagggagacagggtaggtttcctgtccccagattaataaaccaaggtcacttctcctgaactgtgatgatgcctggccctgttcttagtgggcatagatggagttaactttttttttttttttttttttttagaggcggggtttcactatgttacccaggctgatctcgaactcctggactcaagcgatcttcccatctcagcctcccaaagtgctgggattataggcatgagagttagatttttcacatgggatttttgccaattgattagtctgttgccccagccaggattaggacaaaagggctttgcatccccacagcctctcttgattgatcttgttcatgcacagatggaattcggacaccctttgggtatgtgaataacccttacaggccacaggacccagattagtgacaccacaactgggcatcatctgagtagggaggacaggagcactgagctccaagtcagaagatccgaattaaaaaatgaccacctttaatgaggtataattcacatgtaataagtgcactcatttaattggatagtcaatacgttttgacaaatcagtacaccacagtgaccaccaaaatcaaatatagaacattttcacccaaaaagtttctcatgatcttttgtagtcaacagccaccccgactttgccccccagcctcaggcatcactattctgctttctgtcactatgggctaactttgccttttctagaatttcatacacatgggatcatttaggatatactcttttgggtctggaggagacctggtttaagccccacacccaaaattagataactttgtgacccttggcaagacataattttgtcttcaactcagtttccttaccagtgcaatggggtggtaataacttaaaaccagcaagccttccttccttccttccctctccctccctccctccctcctgtccttccatgtgcacaggtgccacagtgagctccattgtaaaattccagaaaggagctgggtcaggggttgctcaggaaacaggagcctctgctccctccacgtgtgtcacagagggcacccgctgcccctccctccatgcccatcccagcctccctggtgccgtggtgtgcaggtccccgcatctccttcaaggtggactccttttatttaaacaagggagataggaagtcaccccggaaagaaccagatgcggtgatgagggcccccaccctcaagatgggcagaggccagaggtgaccaggacctaagcagaggggaggaccatgtcagggggtgggggtgcacagaggcccggagtggggcccgcctggccctggggctcgggacactggagttttcagggggagcagtgagtggaaggctcgtggagctgctggacaccagatgagtgttggcatcaggacacacacattgctcagaaccacccaggaacaatctgatggacacctttgtgcccttcacaacacaactcactgacactggacacccagaagcacttgcagataagagaccactgcacacagagcacagtccctgcttccctggagctcacgtgctaaaacatgacccacatccaggctgcagcccgtccttagccagggatgtggagggtcctgagtctggtcctgttgagtcctgagtcctccagactggccctgccaagttgccaggcatctgatgcagcagagcagcgctatgctgccctctgctggccacatggaggcagtgagtccccacactgctgtccactcctggcaatgggctcaggggaagtggactgtgtttctggtcccttgcttctgacaacctgatagagcagatatggaagggcagaggcactataagaactcttctcccagttccttgattcccccccattattccttgtgtgtcccccacttcccctcccttccctgtgtctggatttaagaaatgacagttgaggcaaatcatgttgctttttcggccatctcctgcagtgtcccctttccatggcctcatcctgtcatggccctgagctgttgcaactggttcagggaggtctctcttggccatctttcatccagtggggatggagagaccagtgccatttctggagggagcacctgagtttggaggtgaaacataggtgataccttatccaggtgacaccttccctaggccacaaaaccatagtttctagatggagctgggcatggtggctcatgcctataatcctagcactttggaaggctgaggctagaggatggcttgaggccaggagtttgagaccagcctgggcaacataggccctgtctatacaaaaaaataacaatttaaaaaattagccgagtgtggtatgtgtgcctccagccctagctactcatgaggttgaggcggaaaagtcacttgagcccaggagtttgaggctgcagtgagctgtgatcagttgtaccactgcatgtcagcctggtcaacacagcgagaccttgtctaaaaaaaaaaaaaataaaaatagatggactggtgccgtgcctttttttttccccccacagattctttgacatgcctcccatgcagaggtggggtctatgtccctctcatgaatctggccaagttggtagtggttttgacccagggttgtgtgaagtgatgtggtgtgacttctgaggctgggtcacgaaaggccatgcagctcctgcctggcttgctgggacactgccacccgagcaagccagctacctgataaccaggatgctggagaggctactcatgggctgtggttcatgatgccatctgagaagtgggtcctctggcccagctcttccagggcccagccttctgggtcactgtcagctgaggcccagacatgcaggagtacagacaagctgtccctcctgtgccctgtcccaattcctgacctggcttctggagcttggtttggagatggagcccaccttgacaatgctgtttccctgggagaatgggccccctcttggctggcttgcaggagctctgggagtctccttcccctgtgactcctaggggcttggtggctctgagctgggcagctccacattctctcaatttcattctgtctgatccatgttagttttatttactttttatgtattttttatttttctgacatagaatctcgatctgttgcccaggctggagtgcagtggggatcatggctcactgtaaccttcaactcctgggcccaagggatcgtccagcctctgcctcccagaatccatgttcgttttaatatgaaagcaacgttttatgcgacaaccaggagctctgaagggttttcacgtggatgagccacacgccgggatttggaattgcgggaagtgcccagcgagtagggtaggaggaatgttgggggtgggactggactagaagggaggctgggacgtcgtcgagaacgagattgcagggacgctgcggtgggagaagtcgaattcccaccctgttcgtcctccgcaaagagtgactgaggctcaaaaagccacagccttgcccaaaacggatgcagcgggcgcaggcacggtccacaccccgaagcttgccgatgccctcggcggcagcccgtcctgcagagccgcgttccctgcgcccaaagcaaggtcggacccccaccgggattcccggaaccgggtgtcccgcgcgtccccagcgcaggcagagacggcgagacttccgggtcggcgttgcacacggcggccggcaggcggcgctggagccccgcgtttgggcagccaggacgcccttgcgctgcttcgggtcctgcgagcgcccagggagggggtgagtgcggggaggggtcagacccgtgtcttgcccggtgcgagctcaccgcctgcccaccgggcacgtccacagcagctcagtcccggtctgagcgcatcggagtgaaaacagcccccgcacctctcgtgacggtgtccccttctctgtccacgttgcaagaagctatactgtactcaccaagtctttaaatcttgaccacttcaccaaggaaggtatgaacctctccattttacaggcccagttcaaaaagcaacgacaaaaatcaacaccagcaaacctttatggagttctaattattgacctggcctgccagggtccttcagagtggagttggggtgggtgcgggagaggggtcaaaagccagccctcaggagggggccacccgcgcagccctctctccaccatcagggctcttgcagacccaagggcctgccaggagaagcagatgggccatggtaaatctgaggggccattgggatgcccagactgtcccaggtcaccccatttctgcatttttgttcattttgttcaggtggccctgaatgttgtgccctcctcttgggaactgtaagtaatacaatcttcctttcaggcagttgactctgtgtctgtcatcttcccatacctgattacaacaaaatcatcccatgtacatttttaaacaactgtctaagattgtcgcagggctcaaatgacttaactttaagtgcttacaatgatgcctgacacatggtaaggctaatcgaggagtagctattgttacatctctttctccagcctcttccttctttgcaccaactgcctccctctgagcaattttgagggaggtttatctcgaggtgcagccaatcccagctgctagggccaagatcagccacgtgctcctttcccttggccatggctttggacactccaagctggcagtgagtgccaggtgagggggctgctaggagccggcaggggggatctcacctttgtgccacttatgtccctaatcaggggcaacctccccaaatctgcacccccaaatcccctccccagcttgactggagaaatcactctaactcccaatgatagcaactccaaatcatagcaataataatttactgagtgcttacagtgagccagacacagtgctagcatcttgtaccagcagttctcaaactttttggcttcaggaaccctttacaccctaagaatgatcaaggccctcaaagctcttgttcatgtgggttgtatctatcactaattaccattttaggagtcaaaacaaattttaataatatttatttataatttatttaaaatagcaataataaacactacatgtgagcataaataatatattcctatgacaaataactatatttcacaacacacaaaatttaaagagaaggaagtgtggctttgttttatatttttgcagatctctataatgtcagccttaatagaagacagtttgatttttatatctgcatctgcaagtttttgagataccacatgtcatgtagcccctgtaatattccactgggagttttaaaaagctttcactgagagcaaaaaacccccacaaataacatgtttgtattattgtcaacattattctgaattttatggaccatctgaaagggtctcagagaccccagaggtgcccataatacactgtggaaactgctgcctgatatacatgatgggtagcttccaatattgccccatttttacatatgaggaaactgaggcacaaggagattaaagtgacttgtccaaggtcatgcagccaggcatcaaagctagctggggagtcacttgattttggtgtccagggtcccagcactgagccctgaaagagagggtaggaactgggcacagaaaaagccggaagggcaggttgggccatgagtgggggagctgggtgtgcagtgaggggtgggggtgggaggggaccgggggatcagttagtcaccaagtggtcctggtgacagggctggagatggcagctggcggcggatgtagcctcgggctggaaaatcaataggtgatcagcggtccaggggcaagctgttcatcaggtgcggcagaggggcaggggcaggggcgggggggctgggaggaaatatcactgacccccggcaggattgatcaaacagccagacacccaaggccaaactcactaataaagtgagacattcagctcagcccggcggctgctgctgaaggtcttaaaaaaaccgcttactggggagttcttgataaactgtctttgtttcttgaggcaagtgggagggaggacagactgtggggaggcctggctcggctgccgtttggcctgggactcatggtttgccccaggtctggaccacagaaccctggtgcttgtatggcatgtgtgcttgcactacagcacatgccatttgtacagggcatgtgcagacacatatgtgcacactatgtcgcacacattcaaatgtgcctgcacatgtctttgcacgcccgtgcacatgctacaacctacatttgcttatggtatgtgtgcacacatatgcatgtgctacagcacatgtgtacaaatatgccttgcatgtgtgcatagacatgcgtgcaccgcatcacatggcatttacacatgcatatgctatggcacatatgtgggcacaaatgtgccttgcatgtgtgcgtatacgtgcatgtgccgtagcacacagaatctgcctttgaggggtgagcatgtgtgcttgggggttaaactctttctccattgtttcactgatatcaccactttctctgcctgtagtcccaaaggtgccacatttgtaatgacagtcatgattattatggggtggggagatggacggaaaagtagggactggaaaactgtatctaaaaggctaagctgtacaacagagagaggcaggtgtgaacaggaagaaagagggggaggaaaagtgaagggccggcatggtaagggctaaacatcgtttggactgggagttgagggagagaaaatggcaggattcgggggtggctgggtagctgttgggggagcaaattaaagaataaaggatatgcaaatataatttttatttttattgatttattttttttaagacagagtctcattctgttccccaggctggagtgcagtggcgtgatctcagctcactgcaacctccacctcctgggttcaagcagttttcctgtctcagcctccagggtggctgggactacagtctcatgcagccacgcccggctaatttttatatttttagtagagacagggtttcaccatattgctcaggctggtctcgaactcctttcctcagatgatctacccacctcggcctcccaaagtgctggaattacaggcatgagccatcgtgcccggctgcaaatagaattttaagaactgtgttgggtaatgacatcctttgacattctttcaggaatccaagtaaagagtagaacctttcccgatcactttctgattgttggactgtgttttgttaaatgtgctaccgtattagactgggcttgtgcatacacagaatttattttgatttaataattacatcactcacattgagaatgaaattttattggaatgcttttgcagatgagaggttttattaagagcttttccatgtgtcatatactaactcgaaggtatggatactacttttatttccattttttggatgaattcattggagctcagaggcttaatcacttgcttaagtcaggtggcttataggaggtggaactgggatttgaacccagccctctgactccagagcccaggctgccttggccattattccagagtatagtggggaatctggggggtcagacaggtagaccaatggaggaacatttgccatccctgtatcttgccccaagataggtgagtagagccctgaggagaggggcagtgcatttggcttgcacaccattcagacccttcacccaccagcagttacagcccatctagccccaagatccctcccccaagatcccctggctgggaatcatctgctctcttgattgctgaagggtgcatggatgcattggaaggggctgggaggatataccaggctctgactttatggtgtgtagaccttaaacccccaaagcctttttggttttataaaagcacagaacaaagtcattgagaatgatcaaggatcgaaaccatgggagaaatataaaactatattttcttaaaatgtggtcattgaaacacctgcattggaatcactggagatatataaaaatggaaattcctgggtgcctcccagatctactgaaccagaatctctgagtctaggggccaagggatctgcatttaaaaaaatgtcttgagtaattcttctgcacattctaatctgatcctttgtatttgctgttccctccacctggcatgctctccctgtagctctctctttggctcccactttcaatcctttagatctctgttcaaatatcctttcctcagaggggtctttcctgctatcttacctaaaataataccccttgcattctcaatactcttgctctgctttattatgttattatttttagctacatggatgctaactatatgtaaataaataatatatagtgtacaatatagataacaatacatgataaagccatttaatccatatcagccttatcaatgtgcttatttgcaccttttggtctgctccctgagaggcgaagctctcggagggcagggctggcctgccttgcttagggttgcaccctcagtgaactgtattgggtctaggagaggttgatatgggggaggggatgatgcatgcagagtgcccaaggcttagtgggtgctcaacataatgactgtatcctaagcgtggtgtatactatgaaaacaaaaagccataagcttccttgttctggtagtaattccctacccctccaccctaaggaccagtgaaactgttatgagagtgaccaagaagaaacgtcttctcttgtcctcttcaatgtctgaattctgcatccagcacattatcttcggtgtctcccccatttacttccctcgccttcttccttaaggaatatcagcaatgataatcccagcgactggccaggcacggtggctcatgcctgtcatccccgcactttgggaattgaggcgggaggatcacttgagctcagaagtttgaagctgcagtgagctatgatcgtgttgctgtgctccagcctggatgacagagcgagaccctgtctcaacaaaaaacaaaaaaactcagaaactataggtactggtagacatgctaatttcacatcttaagtagactccttaactctttctgttgcactggctctcagtcaattttggggaaatctctctgggaggggaactctcaggtccaaggctggcaaaggaccaattgagttcctcttctggaggactgggtgacacagacactcaggtcactgtgtttgccctgaaggtggatggcagatgggctccaaagatgctggggtacagatcccctctgcctttggtaagaggctggggaggtctggccctggtggagcccccaggctgggacctttggaccagagcagcttcatttgtgtacccagtgaatcttacggattttatcacattctctgtgtgccataatgtgaagaacgttgggaagcattggtgtaggtgcaggggtgaaggcagttgcattgggccatgaggccatctgtgctttgtttgctggtcttggaccagcctctgtttgtgagtatgagcttgtctgggcctctgtttcttcaatcagtagcactgtaaccaggacactacagcagatatagcccaggaaggggccaagggtcttgaaagggcagaggcagtggagtggggacgatacagggagtctgaactgggaagggccttgctaagaagaatgtgaagcctaaggtgagacaagagattattcgagagcttggagcattgatatatgagttgggtatgattgtccctatgtttcagacaaggaaaccaaggctcagagtagtggaaaagctcaccacagtcaacggcagaactaagtgggcctgagtgctttcttttcttaatgctgccccttgtagctcaaggaaatttgatgaagagtgttttgaaacttcagctggctcttgacaagtgtttgtgtgacattttggtgggagagatggagatatgtctgctggtatttgggacaattgggtacatcgcatcagtaccagtgggaatagagcagccttgacatttcaccatctgaggaatggcaggaggactgagaccattctgtcggaagaatagaaaacttagagggtgcgttgagttgaataatttgccccaaaagatatgtccactgagaacttgtgaatgtagcctttttttttttttttttttttgaaaaaggaatggccaagcacagtggctcaaacctgtaatcccagcactttgggaggccaaggcaggcagatatcctgaggtcaggagtttgagaccagcctggccaacatggtgaaaccctgtctctactaaaaatacaaaaattagccaggtttagtggtacatgcttgtaatcccagctacttgggagactgaggcaggagaattgcttgaatctgggaggtggaggttgcagtgagctgagattgtgccactgcactccagcctgggcggcagggtgaaactctgtctcaaaaaaaagaaaaaaaaaaaaagaaaagaaaaaagaacaagaaaaaaaaagataaaaggagttcttgcagatgcagttaaactaaggatcttaagatgagatcatttgggattatctgggtaagccctaaatgcagaagaggaaaagacatagacagaggagaagctgctgtggagacagaggcagagactggagaggtgcagctgcaagccggaaatgccaaagactgcgggcggctgcaggagctcagagacaggcatgggacaggttctctctcggaccctccaggaggaaccaatccggccaacacctctattttggactgccctccttctcagaactgtgtgagaaggagaaatgtctgttgtttgacatcaccaagcttgtggccatttggtacggcagccctggggaactcatactggggggtaggatgccgtcctcaaagaaatgagggttgtcatgtggaagagggaccctactcactctgtgtccctggaggaatgtgagctttcctctgagcttctaggtccttaggaaaagggctccgtacagtcagggggttcagggatggagtgggctgcactggggaggtgtgagtaccccattactgatatgccaccagggagtttcaactggcatctgttgtgtagttgaacttgaccatttgtgaggccccctccagccctgagaatctatgcactggtgcaaagaaagaggtaaatgtttagagaggtgacagaggacctagagctaatgtccaggatgctgcccaggggccttagagatggtgacaatggttggtggggatatgggtctgttggagaggaggaagaagaggaagagagcctgactgccaggcaggcaggggtatctttggggctctgggagccccagcctctggattctgccctcagtgagctttgcaggacaccctaccataccccctccctgctttcttctgatagagtcgtttccatttggatattgccttgaacatgatgttcacaatccccaaagggaagaacatccctcaataagccacacaattctcccagccaagaacttgctgttccaaattcattaaaattgctgtgatattctcttcccatttatgtgccaagagccgttgtggacagaattcataataccatggagtggtggatgaaaccgattgtgcagtcagaaagaagtgaacttattttattttatttttaataaaagtgtacctttcaggttggcaacaaatgcgagtgtgggtgtggggaaatggcacactgatgtgtttattaagggagcacaaattggtccaaccccaatggatatcaacttggaaatgatataagatgcaaaatgtgcatggtagttttgagttttttagtctctaaaattcaggtgggcggccgggcgcgatggctcacgcctgtaatcccagcactttgggaggccaaggtgggcggatcacctgaggtcaggagttcgagaccagcctggccaatatggtgaaaccctgtctctaccaaaaaaaaaaaaaaattagctggatatggtgacacagttgtagtcccagctgctcaggaggctgaggcaggagaatcgcttgaacctgagagtcggaggttgcagtgagccaagatggtgccactgcactccaggctgggtgacagagcaagactctgtctcaaaaaaaaaaaaaaaaagtgaaattcaggtgggcaagatatgtcagttttagttagtctgtgattgaatttgttttttgtctcaatacctccctctccctcccttttccaccagaaggtagaaaattaattctaggtaattcaagataaactcgccatttgagggggtcttcagcccattaagatctcttctcttacgttccttcctgggggatttttgctttaccttagtaaagaacctttccttgcttcctggggggcgaggcactgtatttgggggtgcttatgtagtgagtccttgctaggctgtgacccctcactgcaacaatggtgctggtgaaggtgtctgtggaccagcgctgagttatctgcgccatttgctccttactgtgcagcactgagagcctttccggtgtgggtcccagctcacttttctgatcttctcaggtgcacacactcattcagctcttcctccgtgctactttggagctgtgaacatataggggagtcgcctgcggctgcgtatctcccccaccatctctgctagcatggctgaagattgcagatgggagctggctggagcccaggtcacctctactttcagatctccaaactcattcaaggcactatctcccccatcccatactcagcgcctacctgagcagcataccaacccacacggcctttctctggagaccttcatccctagtctgttctcgacctcctccctccagcttagaatgtttcccttgttttgattccctttttgcaggaagaaaagctcactcaacaagcactcttctgcatcttacctcttgaacctcaaagccaggaacatccccactttcctcctctatgctcctccacatcgctccttctgccaggcgggtgcctaaattggagtgagttctgggagaaaaaaaccaatgggggccaggcatggtggctcacacctttaatcccaccactttgggagaccgaggctggtggatcacctgaggtcaggagtttgagaccaacctggccaacatggtgaaaccccatctctactaaaatacaaaaattagctaggcatggtggtgcgcgcctgtaatcccagctactcaggaggttgtggcaggagaatcgcttgaacctgggaggcggaggttgctgtgaaccgagattgtgccactgcactccagcctgggcgacaagagtgaaactccgtcttacaaacaaacaaacaaacaacccaaaaaacaatggggctcatacaacacttgtccttttgtgttcttcttatatgaaatatatagaccagtcaaattcgtggagacagtggaatagaggttaccaaggctggagggagggggaaatggagagttattgcttaacaggtacagggttttgtttggggtgatgtaaaaagtcttggagatggataatggtgatggttgcacagcagcaagcatgtatttaatgtctctgaatgaactgtacatttcatacttaaaacaaccagtgttatgttatatatacattatcataataaaaatagtaaaaaataaataaatgccagcaacagagcagaaaataaaaatcccgcatcacatcagccaatacttgacaacagctttctgactttgacccgttgttccatttaggggtcttgagtctgtggaaaccctggccggggtgtacccagctcgagtgcaggggggcgcgtagcagcagcctggcgtgtcatcgtgagacacgggagacaacctgggtatccatcaatgggggaccaagtgaataaatgatggcggagccacacaatgccgtgctgtgcagtgggatgaagaatgtgccctgctccgtgtatgtgccgacgtggaagatgcccacgatgtattgtgcagggagcagaataatgtgtgtggtagcatcttgtttgtgtaaaaaggcctatatatatggaatgggtatgaatttgctggacatttgaggtaaaggaagtgcgacctccttcttggctccctcccttttttctctctttaccagataaggatttatatttgctttccttacttctttttcctctttccacaactgtgattttctaatctacgtgtctactgtgcctgacagtcattttcatctttttttttttggagggggcccgattctcgctgtgttgcccaggctggagtgcagtggcatgatctctgttcactgcaacctctgcctcctgggttcaagcgattctcctgcctcagcctcccaagtagctgggattacagacggctgccaccatacccagctaatttttgtatttttagtagagacgaggtttcaccaagttggtcaggctggtctcgaactcctgacctcaggtgatccacccacctcggcctcccaaagccctggattacaggcatgagccacagcacccagccttcatctatttttaacatgtaaaaaattttgagagataactaatatacagaaaagtgcataaaacagagatgtctagtttaaacttataaacacccacgtatctaccacccaggcctagacattgaacagtgctaagcacccccatgtgccctccccagttaactccctcaagaggtaactgctcttcatttatagtaacaatcattgcttttaaaaactcattttattacccctgtaatcccagcactttgggaggccgaggtgggcggatcatgaggtcaggaaatcgagaccatccttactaacacggtgaaaccccgtctccactaaaaaatacaaaaattagcctggcgtggtggcaggcgcctatagtcccagctactcgggaggctgaggcaggagaatggcgtgaacccgggaggcagagcttgcagtgagctgagatcgcgccactgcatgtcagcctgggcgacagaacgagactccatctcaaaaaaaaaaaaaaaaaaattcatttcattttgaataaatttagattgatagaagagttgcaaaaataaaccagagaattcctgtatgccctttgtatactcacatacccttcactcgccttcccctaatggaaacatcttacataaccacagcatgtttatcaaaactgagattgacactggtccaacactatttaccgaactacgaacttcatggatgtcgccagtttcccatgaatgttctctttctgttccgggatccactccaggatcccatattggatttagttatcatttctccttagtttcttccatccatgactgtttcttggtctcttcttgtgttttcatgactttggcacttataaagagtgcttgtcagaaatttaagtagaaaagtaagaaaagccaggtagaatccttgcttttctttgtaattttcctctcctaagtatatatccctgaacaacatagttaggtttggcctgttttgaattttatctaagtgaactaatacacgcatattcttttgtgtcttacctttttcatttaacattatgtttttgggggaaccattcatgtttttgtgtgcagctgaagttcatttttcttgctgaatattattccgttgtatggctgtaataataataatgcaatggctataattctggattgtttctaggttttggctattgcaaacaatgctggctgaagcattgtttctttttattttactttaagttctaggatacatgtgctgaacgtgcaggtttgttacataggtatacatgtgccatggtggtttgctgcacctgtcaaactgtcatctaggttttaagccccgcatgcattaggtatttgtcctaagcattcttttttttgagacagggtctcactcttgtcacccaggctggagtgcagtggccccatcttggctcactgtaatccctgcctcccagattcaagtgattctcctagttcagcctcatgagtagctgagactacaggtgggtgtcaacatgcctggctaatttttttgttttgttttgttttgttttcagtagagatggggtttcaccttgttggccaggctggtctcaaactcctgacctcaggggatccgcctgccttggcctcccaaagtgctgagattataggcatgtgccaccacgctcggcagatggccgaagcattcttattacatatctcctgaaatagttgggcccacatttctctaggagaggaaaccaggagataaatatccaggagaggaaactttggctgaagaatttccatgtcttcagctggactagatactgccagactttcttccaaagtggttttaccaatttaaacagccccacctgcagcgtcaagttctcagtgtgccctatcattattttttcccctagtccttagtaacagacatcattattttttgaaatcaaaataaatcagtcaagattctggcaggaaagagatgtacacaaaatgcttataacaatgctagggttctatttaagagcatttaataaagagattatttatacaagagtggccaggatgaaaggaaccaataagaaatgctgagacacccaggcactagggcagcaggaagctgttgctgcctctggggctgaagggacaggagggagaagaggggaaagcggaggtccctgcctgggctgtaagcacacatcagtgtttctcaacccgtccttccttcctttctttctttcctttctttctttctttctctctttctttctctttctttctttctttctttctttctttctttctttctttctttctttctttccttccttccttccttccctctttctttctttctctcttttctttctctctctctctcctttctttctttcttttctttctttctttctttctttctttctttctttctttctttctttctttctttctttctttctctttctctcttctttcttttttgagacggagtctcactctgcagtaaagtggcacgatcttggctcactgcagcctctgcttcccaggttcaagcgattcttgtgcctcagctccagagtagctgggattacaggcacctgccaccacatctggctaatttttgtatttttagtacagatggggtttcaccatgttggctaggctggtcttgaactcctaacctctagtgatccacccacctcagccttccaaagtgctgggattacaggtgtgagccaccatgcccggcctcaacctgtttttcatcatgacaccctgttgcatgttgaattgtgtcaccatccaacatatgttcaagtccaatatctgtgaatgggaccttatttggaaatagggtctttgcagatgtaatcaagttaagatgagatctgtcttagctcaggctgctagagcaaagtatcatagactggtctcgaactcctgacctcaagtgatcctcccgcctcagcttcccaaagtgctaggattacaggcatgagccaccatgcctggccctgtgctgtggctctttggagggtcacaaattattgcaatatataaggttatgtctccccaggaaccagtggtcaccctcttgggggcgtgattgctcttgttgaggctgcaggagccagagggaagagccaaactgaggggaggcagagaagggaccagagaacagacccccttccctgtctttccacccactcctgggtggcctcctgctggctggacttagccaagagccaaggctgagggggttcaggggtgctgccttctgagatcagccccggggagcagggcagggctaagaggggcagagaatgggtgcaggttggggcgcccatgaagaacaactcagttcacagccccagctgctcccagcgtctgccagtccttctgggggctgtccttcctctgctagaaaagtaggagacccccccaaggccaacatggcccagaaaaatgggaggagaggctgattttccatccagatggcctctccaggtgatcctgaaccacatgacctatctgaagctgggcagctgcacttcctctgtgcccagccaggacgaggggctcttcacgaggctctgatgttgtggcagtcaatacaggcctcccccagcaccccatagccctcctgggtgccatggaggagtgcagttcagcatccctggcttgcagctcccccacctccccacctggcctccccaccccctcctctttaacaaggcttggaacccttcccctcccagactcttcaggtctatttcctcagggaatcgaggtttctataaagaaaagcataaaacgagatgaacatcagcatcttagggatgatcacagacagcagagtatgggagattagtttgggttctgggccaggttgcctgggtttggatcctggatttgctactcactggctatggaaccctgggtaggttacctaacctctctgtgcctcagctctctctctgaaaagtggggatatgacaatatctgtcttacagagttattctgagcattaaatgagctaatggatagaaagtgcttagaacagtgccaggcatatagtaagtgctatgtaagagttagatctattattactttgctaggtgtgtctctattttgaatgtgccatagaaagttctagagttggctggccaggcatggtggctgatgcctgtaatcccagcactttgggaggccgaggcaggtggatcacctgaagtcaggagttcgagaccagcctggccaacatggtaaaacactatctctactaaaaatagaaaaaattagccgggcgtggtcgtgtgtgcctatagttccagccactcgggaggctgaggcaggagaatcacttggacttgggaggtggaggttgcagtgagccaagatcatgccattgcactccagcctggagtgccaagagcggaactccgtatcggggggggaaaaaaaaagaaagttctagagatggctaatggtgccacctcacgggagtagagctgggcctacaggagaaaaactttcactttttaaaaatacttactttatgttattgaaaaaaaatttttttgagacagggccttgctctgtgggagtgcagtctcagactggagtgcagtgggggaatcatagctcactgcaacttcaaacgcctaggctcaagcagtcctcctgcctcagcctcccacatagctgggcctatagatatgaaccacctatagacatgagccaccccaccacacccagctaatttttattgatttatttttggtagagacagggtcttgctatgtttcccaggctggccttgaactcttggtctcaagtgatcctcccaccttggcctcccaaagctctgggattacagtcatgagccatagtgtctggccttatttaaaatttttaaaacaagcaattgtaatagtatttaggaataacatatttgctctagaaattttaactttttttttttttgagatggagtctcgctctgtttctcaggctggagtgcagtggcgagatttccgcttactgcaacctctgcctcctgggttcaagcgattctcctgcctcagcctcccaagtagctgggattacaggcacctgccaccacacctggctgatttttgtatttttagtagagacggggtttcaccatgttggtcaggctggtcttgaactcctgacctcaggtgatctgcctatctcggcctcccaaagtgctgggattacaggcgtgagccaccgcacccagcctcagaaattttaactttttaaggtaaaatataagtttttgcaaaaatatgataagctttgcaccatttagtgtggaatataagacatgacagattgtcgtcagtctccctttcactgcatgtgagcttccagagaaaaatttatgggtgttcctgggattggggttggacttgcctaattgcctagattgggagttcggtaaacttctcctgctggacgtggaggaggggctgagccttgggctgcattctctgcacccacctctagtaggcctcccaggaccacccaccgcccagcacctgccctggttgccagggaaacagccctttatcgagtggagccatccccaactcagcccagtgatttgtccttgtctaattattattactctttgcattttccttttggatgagtgatgggggagggtcggggggggtgggagggtgcaggagcagaggagcagtgatttgtggggctggcagcttatctttgagaggaggacatttatctttctggaagcagaaaaccgcccaatggagacaaattcagcagttcccgagtggttctgtttgtggattcacacactgatctggagttaccgacctggaattgcatgtgcacgtgggtttggggtgtgggaatgtgcgcacgtagcaagcagacctctcagagtggctctgtccagagccacagtcctgtgagcgtgtctgtggttattgtgtgctcactgtgtacagctcctaaaatggtatgtgcacacgtctgcatgtgtctgaatgtgtgtgcacactttgactagactaggcaacctaggtgtgcctgcttgcatgcactcatgtgataacatgtggctgtgtgtgcacattgtagacaaagcaaggaaaagctgggtgggtacagattgaatatgtagctatcaaatgtgtttgtcttcatggggctctgtgtgtagggcctgagcacatgtgtagccaacttctgagcaggcctgcatgtgaacattgtacacattgttatgagaaccaaaaaatagaccgtaaaatcagggtgctgacctaagccagagacacctgagatgaaggcatagggtttggatagtatggaagatatgcacactgcacattttagtagctggggtagattgcaaaaacatccccactcatttgtccctgcccgaatccttgccctttcaatgtgactttgcagttcctcctaatagaagataaagtctattcccctaccgtcttgacctggactggacttgaaacttgctttgggcaatagaatgaagtggaagggacaatgagtcagttctgagcctaggcctcaagacagctggcagcttccactagctctcttagaactgtgcccagctgcacatgaacaaggctcagctaggctgctggaggatgagggaccattagagactagggggagaacagccccagttatcctggctgcagccatcctacaccatcttagagccaactgacttgcaaatacatgagagagtccggccaagaccagcagagctgcccttcctaacctttagttgaccacagacacatacgtgagccctgctgactcacagacatgtgagcaattacagttgtttttaagtctcgtgagtattggggtgatttgttatgcagcattattgttgcagtgcataactcattactaactaaatactcagcatacacacagatgatgtacacacacagcaaaagcatataccattgacatacacataggattgttggctctgtgtactaaaagtattagttagttatctgttgctgttacaaattactccaaaatttaggagcttaacacacaaacatttattacctcatagtttctgtgtctcaggaatcagggcatggcttagctgaatgtctttggctcaaggtctttcatgaggttactgtcttattattggggctgcagtctcatctgaagactcaactgagggagtatccacttccattttcactcacaggttgttgtcaggattctgttccttgatggtgattggttggggcagggtctccctcaattccttgccatgtggggttttccacatggcaagcttacaacattgcagagtgagacagagagagagagagacagagagagagagagagagacagagagaagcaatggtttttttgtaaccttattgcagaagtgacatcccatcatttttgccatatttgttagaaaaagtcacgacatccagcccacactcaaggaaaaaggagaggggattacatgaagtgtgaaaggagtggggggatcactggggactgtctcagaggctgcctaccacacagggtgtacaaataaataggctcacattcagctggactagctgtacaagatcagcctttttttcatggcttttgctcagccaaagacactgagtgtcagagaaagtgggttttgcaggttctaaagacccaggtattctattctcttggtcctgtcattggagctaaggctattttgcctagaaaggaagctctctctgctgtgggatgggggaggaacacttcactccagaccttccaaccaggattccagacattcacatcctgaagcttgaggagggacaggaatcctcaggttctcagagaggaggagcctttacttagggtgtggctggaggtggagatgcttgagaccctctagaggggcagatgctgagagctttctcctttttgggcatctgacctggagtaatgtggtctccctgtgggatctgattttccttccaagccctttctcctctgtggtctcagggctgggctgtctatgaacatcgcagacccagcctacacttccccgagatgggcaagcccaacctcttcctccttagagctcacctgccctttccactcccttcccaacctgcaatttcaggtccctttgtcccctccccacacccagagctggatattgatgacctgggaccctgtacactgcagcagcactgggcaatgcgcagctgtgtgtgtgtgtgcacatgtgtgcgtgtgtgtgagggtggtgggactgaggtggggggggtggatttcagtccccatatgaagcctgctgcagatcaaaataggcagatgaagtcaggagtggtggctcacgcctgtaatcccagcacttatggaggcacaggtgggaagatcgcttgagcccagtagttcgagacctgcctgtgcaacacagcaagatcccgtttttgttaaaaaaaaaaaaaaaagaagggtagatgtcctgccctgtgaaccagcctcatgttgaaaccttctgttaggagagtggagggcaatgtgtcctcccagagtctatgtggggctccagcccaaagctgggacccactgccctgcaggtattcacccctctccctgcttagagctgcttactgcactgcccagggggccagactgtccacccccaggacaaacttgggctaagggtgaagtcacgtttcccagctcagagctcttgaactggagagtttttgagccccttgtgtagggtcccagtccctctgctttgaacaaacgtgtgcgtgagggtcttgacatggtccagggagggatgatggagtttggactcggggggaggcggtggggatggagagaagtgtgggtgggtttaagagacatttaagcagtcgggctgacaagctcagaggatgtagatatggcggctgggtgaggagatggtgcaggagggagggggaggaggaagaatgacacacagcatgttttctgtaaagttcactggggataatgagtgcctctggcatttgagtaacaaatacagcagctttagtctcctgtccgggattggctctgaggcactaatgatacctaatgatatctgcatgcagaacttccagaagggcaggtagaaacttagctacaagaggtcgctttctgggaaaagaggcagagtgtattccctgaaggctgtgtttccgtaggaagttggaagttgggcatcctgagactctgcaaggacagtccatgtccacccctcccctccaagcccctacccactcaaggtcatccctcaggactggttcctccgtgccttttctccttacccctaccctttgcttcaatccagccctgtttctgtttttgttctctgagctctggactctgtatttgtcaggactttattgacttgtgtaatgagacacttagagatacatccgctttcaggaagcgctggatccaggagattggccagtggtgtcaggtgtcagctgtgctttgtctttcaatgctcctttccttttcatgttctttgaaaagttttttatgaaaaaatttttttttgacacgaggtctcaccctgtcacccatgctggagtgcagtcatgcgatcatagctcactgaggcctccaactcctgggtttaagggatcctctcacctcagcctaccaagtctctgggattacagactgagccactgctcctggctctgtgttcttgagtctcagtctacacagctgcagcaaccctagattttcactttcatgctgaacaacctcagagcaaagaagacctttattttcaggacagttccagcaaaagcctcaggactgactcactggtatgaaccagtcactggcccagcaggacgtggcaatttgcctggctgggcatgtatgggtgctcactctgagggttggcccagcccagctcaaaccacacagcctgaacgtgggagaggggtggtcctcagaatgaaattggggtactaaaagcagagcaaagaggaatggaggccaggcagagaggacccatggagactgacctcagaccctaccttgtctctgtctccttcctggcatctttgacttccagtattgggaactcactcactcatccaaccccaggtttggctctgacactgctttggtcacctggggtaggaaattttgctctggactcaccaaaccttgttcttttcctaaccactgaagaggaagcagtgtataagggtcctccagagaagcaggaccaataggatgtacatgtacacgtggaaacagattgattctaggggcatgactcctgcgatgatggaggctgacaagtcccaaggtctgcagggtgagttggcaagctggagatcccagagagctggtactggagctcctgcctgaatgctgggagagacccaggaagagctgatgtttccattctaggaagagcgcaggaaaataggtcaatgtcccagttggaaagaggttaggtaggaggaaagattcacttttacagcagggagggtcagccttttttcttctattcagcccttctactgactagtgaggcccacccatattatatgtggtgggggacagtctactttactctgtccatttaaatgttaatctcatccccaaacaccctcacagacacacccagaataatgtttgaacaaatatctgggcactccatggcccactcaagttggcacataaaattaaccatcgcaagcaccaagtaggtcatctctgaccctctctaaggccgggtcagagagctggtcagaggactgggctgagttggaactctgacagggcatcctctctgtgccccgaatgacctttttgcctaccttggagcaggttgtgtatttcatctgcctgtacctcattccaaaatattatcttccttggttaccatcagggcgggggacccaggcgaggtctgttgccaagttccctccataggctccaactctgtcaggacggggtccactctattatctccacactgtcctgtgccccgggaagcctgactcctgggggccggggcttctgggctccaggcggggtgggtcctaggagcccccttgggatcggagaaatgggggagagctgccaggggtcggttcccctgctcctgccacaggtgtgtccctcttccctggaggcggccctccctgcggctcccccggcacaggctcaatgacactgcccttcttcctctcaccctcaggtacagggacatggctgctcctgctggtcctggttccagggggctcccctcccctgttggggctctcgaccgtgcccacacctctgacagtcccctcattttatctctgcagaatcccagcaggctgtgttgagagtagtgttcctgtgggagctacccagggggagcgggggccagctcggccctgagaggctgtgttggggggaccgtcctaccctgtgggcactaccaagtctatctaaggctttgtgtccagagaaggctcagagcagtcaacagggttatcctaagcgaatcctaccctccatcattggtatgatgaatttgggcagttaactgagcctgggtcactttcttttatcgcctctcattcattgtgtgacccatagaaagtcaagtcaggtgagctttctaagcctcaattgcctcatctgtaaaatgggtatactaagacctcccccaaggccactctccatagcttatttcatcctgcacagtggactttgtctttggggagaattaagtttggccccaatttcattcattcatttgttcatacattcagggactgccccctggacttcacagcatgctagaggctgggttggacccctacccttcaggtcagaagcaacttctctcccttctctccctttctccttcataaagattttttttttaaaaagttgactttatcgaggtataatttacataaaatttgtatatttcaggtttatagatcaaccatctttgacaaatgtatacacctgtgtaatctgcaccccgaccaagacatagaccatttccatgagtctggaaagttccctggagttttgttgcagtcacctgccacccacccccctcaccatcaagccacgtctgatccagtttccatcactatctctcagttgaaattttcatttgctttcattttgcctgttgtaccctttccctttcccttccctttctttttttctttttttttgagatggggtattgctctgttgcccaggctggagtgaagtggtgtgatcacagctcactgcagccttgacctcccagactcaagcaaccctcccacgtcagcctccagagtaacagggactacaggtgtgcaccactactggctaatttctaaattttttataaagatgaggtcttgctatgttgcccaggcctgggctcaagtgagcctcccacctcagtctcccaaggtgctgggattatagatatgagccaccacacccagccgtgttttacacaaggagagcacatgtctccttggtaaaacaatattcattttcctataacctatctttttcaaccattgccagtaatggccagataaaatacatgaacacaaacacagacgcgtgcacatacgtgtacctatgtacacacacaatcctctcacatatgcacattcacacttacacacatacatgcattacacaaacttacatatatgcatacaaatataggttaaggaaactttttcaaggctcaaaaagatctaggccatggtgagacagaacacagttgtgtttttactgaaacccctcgtgatagtgcacacatgaacacacatgcacacaagccccaaagctgagaatcatttgccatcacttcctgctcccctgtcagagtcagcgcaagaggagaaaaatcggaattctttccctgtctcaaaagtaaaagggacaaattagtttcttgtcagtgcactgcaataaatacattgtcatttttatcccccagtgaatcatagtctccatttctcccgtaactattatacagtctgctggcactatatcattttttggtaattttattttcaccaattgttttatgaaatttttgagttttatggacactaaaacaaatctagcctgcgagtgttatagccctttaaatcatcggcaggaaatctcaaggttcctccagactgtggtggaaggaggctttagggaagaaagatcgcccctagcttataaactgagcaaaaacccagagataagtttgtaaaagggacatagatcatggcgggtgaaaactggggtgtaaaacatctccctgctcagctcctataagaataaaaatggacttttatttagcagaaacactaaagtagttggggagaaggaacacatggtcctaatctcctctttcttagccacaagagcctgtatttccctgtgggtcagtgtgagcctaactccagcagctcatagccaggagggtaaccaggttagggaccatctcagggaagccaagaatccccgtgatgttggcacaaaacacaaccctctatatgaatgtcaaggtcatatctctgatgtcagtggaaaaagggataaaactgactctaaagcacatgggaaaagaaaaaccaacaatccaatccaacaagaggagaagagctaaattgatgtgaaagaaggtttgccttaccaggtattaaaatgcattataaagctacaataataaaagcagcatgttactggcatacgactagacagacaaatcaatggaatgaaatagtcctaaataaaactcagtccatgaaaaatgaaagatcacatatcaatagaagagggatggattattcagtaagtgctatctgtaaatgtggtaatttggaaaacagtcaatttagatatttatctcattcaagagtccaaaaaataaaaactagacagatgaaacatttgaaactaaaaaattaaacaataaaatgctggaagaaagtattaaaaaagtatttgatttccagatgaggaggcttttatccatgactttgggtagaaccgctaagaaaaaagaccaacagatttagcttgcaatatgtttacatgcctgcatttcaagacatatcccccacctagaggccaaaagaggctgggcatggtggctcatgcctgtaatctcggcactttgggaggccaaggcaggaggattgcttgagcccaggagtctaatatcagcctgggcaatgtggcaagactctgtctctacaaaaaataataagaaaaaattagccggacatggtggcataagcttgtgattctagctgggagggtaaggtaggaggatcgcttgaacctaggagattgaggctgcagtgggccgtgtttgcaccactgcactccatcctgggcaacagagcgagaccctgtcacaaaaaaaaaaaaaaaaaaatgctgaaagataagctgaccaaatctttttgacatacatgacagcaaaagggaaatctcttgataaagaaaatcactaggacttaatggaatgggcagaggatacaaccctacaattcattgaagaaaaaacaaatatctcctaagcgtaggaaaacatttcccaccatactagctgtgatggttcattttatatgtcagcttgtgcccagacatgtggccaaacattattctgggtgtgtctacttctggatgagattgacatttgaatttgggtagaccaagtaaagcagattccccttcctcatgaaggtgggtctcatccaatcagttgaaggcttgaatagaacaaaaaggctggccctcctgcgaatagaggagctcctcctgcctgactatcttcaagctgggacatcaggttttttttcccctgggtttggactcaaatggaaacattggctcttcctgggtctcaagcctgctggcatttggactagaacaacaccattggctctcctgagtatctagcttgcccaactgcagattttggaacttagcttctaaaatcgcacatgccagttccctctactgaatctctttgcatatcaatatcatctctatctatccatctctcctcttggtgctgtttctttcgagaactgtgactaatgcgctgggcatcaaggatatacaaattaaaatcccactgatatgctagtttttctcatgcctcttgattttttgagaattctctgggattctcctgatcagaatctagacaaagcttatccaatgtgtggcctgtgggctgcatgcagcccaagacagctttaaatgtggctcaatgaaaattcataaactttcttaaaacattatgagtttttttgctatatatatatatatatatatgttcatcagctattgttagtattagtgtatttatgtgtggctcaagacagttctttttttttgagatggagtctcactctgtcacccaggccggaatgcaatggctcaatctcagctcactgcaacctccgcctcccgggttcaagcgattctcctgcctcagcctcccgagtagctgggattacaggcgcgcaccatcatacctggctaatttttgtagttttttctttttttagtagagacagggtttcaccatattggccaggctggtcttgaactcctgacctcgggtgatctgcccgcctcagtctcccaaagtgctgggattacagccgtgagccactgctcagcctcaagactgttcttattcttccaatgtggcccaggaaagccaaaagattggctatccctgatctggacattcttaagtgtctcccaacttaaaaaatgatctctctttattcccacagctgtgtcaaatcattagctcctcttgtccctctcacagcccactttctttaaactgctctcaagacctgcctcttcctctcttgccatccagtcgtcaaacccttccacgtggcttcccacctgtctctcctgcggaacctcatgtctgggtcctcatcagggtctgcctgtccaccactccaggggcgccgtttgcaggactttgatgggggtgatgccctgctgtgcagtacagctgccctgctgcagatccctgggagcttgcagccctttccttatcagagctttcaggtacatttgacccgaggctggtagaggtgaggtttatgggaggagaagagaagagagccttccacggagtttttaacccgcatttctgccccactctttggaagtaaatgagtacatgctatttccttgctatctcaggtaggaaaaacaagctccaaagagtcatccttttcattttatttaactttgtgtttaaaaatgtaacagatactccgttaaccctgaaaatctgaacaagtcttactagttctttctacccacccaccttagcttgccttattattattattttttgtgatggggtctcgctctgttgcccaggatggagtgcagtgatgctatcatagctcactgcagcttcaaactcctgggctcaaatggtcctcctgcctcagcctcctgagtagctaggactacagacatgtgccttcatgcccggctaatttttcttattttttgtagagatgggggtctcactatgtttgctcaggctggtcttgaactcctagcttcaaacgatcctcttgcctcggtctcctaaagtgaattcgctgtattgttaatgtgcaaatcgtagcatctggcacataggaaaaggtataggagctgtcatttgaacccaggtgtcctggcttcacaatttgtcatttatgtcctggatgctggttgcctctagcctgttctccccccagcagccaaagagaacattctaagactaaaattctatcactctcccagtataatagaagccttcaaaggcttctatttgcatatacaataaaagtcttgcctggcccccgcctgtctctccagcctttctttcccacctgttccttcgatcactttggtttaaccacagtgacctcatttatgtttctttttttcttgagacggagtctcgctctgtcgcccaggctggagtgcagtggcgcgatctcggctcactgcaagcacggcctcttgggttcacgccattctcctgcctcagcctcccgagtagctgggactacaggagcccgctaccacgcccggctaatttttttttttttgtatttttagtagagatgggctttcaccgtgttagccaggatgctctcgatctcctgaccttgtgatccgcccgcctgggcctcccaaagtgctgggattacaggcgtgagccaccgcgccccgcctcatttatgtttctagaacactcagcacttgctcatgtcaggaccttcggctgagccgtgccttctgccctgtcagctcctccctgctgggtttcctgtggctggttcctgctgttccttctggttaggcttcagattaacccccacctcatcagagaggccacccctggccacagtttaaggagccagtgagtgccccttttattggttatcccagttgatatggtctggctgtgtccctacccaaaatctcatcttgaattataatccccacaatcctcacgtgtcaagggcgggaccaggtggaggtaattgaatcactggggcagtttcccgcatactgttctcgcgatagtgagtgagtctcacgagatctgttggttttataaatgtccgacatttcccctgttgcactcgcttcagtttgctgccttgtgaggaaggtgtctgcttcttctttgccttctgtcattattgtaagtttcctgaggcctcctcagcagtgcagaactgtgagtcaattcgacctccttcctttgtaaattacccagtctcgggtgtttcttcatagcagtgtgagaacggactaatacaccagtcttttgttggtttccttttcagcacttttcatagcttgcagttttcttattttatttatttcgttttattctgagacagtcttctgctgtcacccaggctggagtgcagtggcgtgatttcagctcactgcagcctccatctcccaggttcaagcaattctgcctcggattcccaagtaggtggggttacaggcatgagccatcacgttggctaagttttgtatttgtggtagagatctggtttcactatgttagccaggctggtcttgaactcctggcctcaaatgatgcacccaccttggcctcccaaagtgctggaattacaggcgtgagtcaccatgcctgaccaacttgcaatgtttaaaagttgatttgctgcttgctttggctcttgtccattagaagctaagctccacgaggacaggagctcccttccctgagtgttgtggtgtgcccagccccaagcacaatgcttgggacatagaagacacttagaatggagaactatccaccaaattctcccctctgtcccactgaacaaacagcactgtttcccagagaggtggaaggataacaagtgggaacttatctggctgagactggtagcagctgtagatttgtgaagaagggggcagcctgtttacattcgcttatttatttatttatttatttattgagactgagtctcactctgttgcccaggcttgagtgtagtggcttgatctcggctcactgcaacctctgcctcccagctcaagcgattctagtgcctcagcttcccgagtagccgggactacaggtgtgagccaccacgcccggctaagttttgtatttttagtagagatggggtttcactgtgttggacaggctggtctcaaactcctgaccgcaggtgatccaactgcctcggcctcccaaagtgctgggattacaggtgtgaaccactgcacctggctaacattggcttatttttggttctagattgatgctttgcgaactctaacatgcacgggcaatcacttgggatcttgttaagatgcagattctgatgcagtaggtctggagtgtggcttagatttggcatttctaaccagcactcaggtgatgctgatagtgttggctgctttagggggtcacatgtaaagaagcaagggcctggttctcaaatttggctgcatattggaattacctgggacctttacctagaaattctgatgtaattggtctagggtatggcctggttattgtttttattttttaaagtgcacattagtgcagccaagtttgaggacccctgctctggacagtgttttacttcatacataattgtgatcaaataaagacatttgacttgtcagaattcttttcatgaagagcattgcatttttatgacaaaggaaatttccttgacaagcttgcctgagtcacagcagggcctgaaagtgggaagaactcttctgcaaagacaaggtagtgatagggctctgcctaccttagggagaagagggaaggtggaaacagagccgcaagctggtgggtaataaatggaggaaggcctcctgctccttccccttaaatcttcagaaagttaaatagtgaaatgcttgaaaataatggaatttattttaaaggatgccagtgaaagcagtagcagttcccaggcatacttgcagattttaattgcttttaagttcttacaaaaattccaaattagctcaaaatctcagggtaggacacaggccccagaacttgctgaagctcacctgcagattccaacatgcaggcatgtttgggaacccctgggttcagatgagcctcctgcaacccaggcagatgaatgcagggtgcaaaggcagagagaagccagtgtgaggcattgcaggaattccccaaatgcagagaatgttctggactctaagcttatgaaatcaggattcgaattcaagtggaaccagaactccaagccaggagggtcccagccaacaaccgctaaggaggcacttggtttgagagaatggcttcattaagcctgtttccttctctgttaaatgggaataataacacctgtgactaagaaatgttttgaggaacagaggagaagatgtggatagatttgctttgttatgtgctgtatagagaggcagctccatatagctctttgaacgtggtttgctactttacagggcacagcttttgatagaaagggatagtggagaataatttgtgaatctagggtgggaagtatccaccagtacaggaaagagaggcactggctgaatcgccaccttgtggtggaaacttgagttgcaggagtgggagccagaggcttaaaatgagtagacttaaatcgtaccaagcctagcagggtttctcaccctctgcactgttgatattttgggcaaaataattcttttttgggggatgttttgtgcatggtaggctatttagccgcatctatagccttttcccactagccacacccctcccctgcagctgtgacaaccaaaaatgtccccagacgttgccaaatatcccttcccaggggcagaattcctcctggttgaaaaccagggtgctatagaaaacgtcaaacaacaacaataacaacaataataatatcttctagcagtttttgagtgcttaatatttctagtgctttgcctaacatgctaaccactttacatctattgatttctttgatcctcacaacatctccccatctccaatttgaggaagctggccgggcatggtggctcatgcctgtaatcccagcactctgggaggccgaggtgggtggatcacctgaggtcaggagtttgagagcctggccaagaaaccttgtctccactaaaaatacaaaaattagctgggtatggtggtgcatgcctggaatcccacctactcaggaggctaaggcaggagaatcgcttgagcccatgaggtggaggttgcagtgagaccagattgcgccactgcactccagccttggtggcagagtgagattctgtctcaaaaaacaaacaaacaaaaaaaaactgaagctggagaggtcatactttcctgggatgttcccatgcttagagaaattgatggagcttagtctggagtagagggtgtctggagaccaaaatctatattagtttcctaacgttgtaaaaaaatcacagtaaacttagtagcttagaacaacaccaatgtattatcttacagttctggaggtcagaattccaaagtgggtcttatgggctaaaatcagggtgtcatagggctgtgttccttctggaggctctagagaagaatctgtttccttctctattttagtgtctagagccttcctttgcccatgcccctccatccatcttcaaagcacatcattccaacctctgcttccgcagtcatgtcttcagacctatgtgggctgcgtgtctgagggaggcagccccttcctggagccctggagagccttgctgagaagaattcgaggatcttacaggaggcagatattagctgatactgagaagagatttctaaaaagcattcttgcccagggctaggctgggttgtgtagggatttgaccatgggagggagtagctgagatggatgaaggtggaggtccctggagatggggaggtaggggatgcctgacagccaggatgatggatgggttgtctaggtgcaaggcgactctcttaggacgatgctggctattgggtgaacaggagcctgagcagtggccaaagtcttcagtgtgtgaggggatgtggccaggaggtcagaggctgggagagacaaggagagaagggtggtagatggggccagctgcatgggcgtgctgccagggcagtcccacaggcttggaagagccccgtgcttcatggtcgctgtcttgaaattcttcacgattttatacttgaatttgtgttacaatggagagtgtgtgcctctgcctgtcattgcctccccagggcaggcacccacaccctcaccccctgccacttggtcctgttctgatgcacactttttttcctattgactgaatgatgcacactttaaaactgggtaattgagagcagtttaatgaaggggccatttatattcatgtaggcagagggagggagtcacaagggatgaggtggtgtcccgagctagcagctgtagggagcctttagcatctccaggcaaagaggcaaggggctggtggttaccagcactcagagcgggagttgtgtggagagagctccttgggtagagggacacagccaacccatggtcacccacagggaccctgcagagcaggagccagaggatgagtcctcagcctcatcctccctccttcaggtctcctgccagtgctgtctagttcaaccaggagccagagggcaggcggtccataggtcatcctctccggccacctagcagtgggaggaggctcttgagtggacctggaggggccagggggctactggtgggggtggaaaattctgaagagagtcaggttggggggacgtgcccagtttaggcctggcctggtgattcgaggtgcatggagaagtctgggaaaagctggagtcaggatgggagggccttcagcattttggtcgggtccctaccagccttgcacacccaggttggagcagacccagatgtggaggggggcttgggagcctttgcaagtctgttctgtaaaactcactttccattttgcccgggaggagcagctgctggctgggaaaggcttaccctgaccccaaccacctgctcccttttcccagtcagggctttcgccccagccccaaccccgggggtgggtagttttgtctttcccttggcccctggctggcctggccagcaacagctctgtctcctgctgtcaggccaccagaatgtgacaagtggcagatgggcctctgatcaatggaccccatccccaagcaaggacagtggggctgggggcagggtggggagcggccgctaatggatgggcctgagagcagtgacggatgggcagaaagaagctgccatttgtcttggaagtgagtgactccagggaggaggagaagggagggtggctgttgggctccagggtggagagaaagcaaccggagccaaagcccagcagggctgggaggatggggcctgagggtgccctggatgggatgggattgggagaaaggtttttcctacctacctttaactagagctcttcagtcctagccaagagggtcctgacatgttgagtggaagatccaggggcatcctgtaaaaatggaaactagatcatgctctcacctgggtctcattcagggtgaagtcctatccttgcatgattctcctttaagaccctccacggtcttcctcaccttctccttttcctccctgacctcacctctcattaccctcctcgctcatgcctctcaagacaatttactttcttgttcttaaaggtctctaggcctttgccccagcagtcccctctacctggaatgctctttccccagatatcggcacagtatttattttttgagacagaatctcactgtgtcacccaggctggagtgcagtggagcagtcttggctcactgaaacatctacctcctgggttcaagcgattctcatgcctcagcctcttgagtagctgggattacaggcgtgggccatcacacctggttaatttttgtattttttgtagagatggggtttcaccatgctggccaggctggtcttgaactcctggcctcaagtgatccacccacctcgggctcccaaagtgctgggattacagttgtgaggcaccacgcttgggaggatatctgcacagtattcttatgtcctgaaggtcaggtgtcagggcagccttccctgggcactccttataaacagcaatgtctccctgccccatgaccccgtctccatctggtatacattatcactccacctctgccttgttattttaaaattattttgtaacagccaccatctgaaatgtcatttatttgtttactgtctaaggtctgtctcttccactagattgtagattccatgaggacagggcgttgtctcttctctttgctgctctatttccagagcttagaatagcactcagatgggctcaacaaatacttgttgcatgcatgaatgaaagggttctaactccagttttgatgcttcctggctttgtgagtttgaaccatctcctgagcctcagcgtcctcatttgcaaagggagggggactgtccttcttcccagagcccctgtgaggattatgcaagacaatgtgcatcagccaatgcccatattttagagaagtctagaaggcctgggacttgttgaggttggaaaagaaaactgcctcatatctccattcatccagccagtaacaaattctcaaagtaagataagacctgggtctaaggataaaattaaggatgttgctgtaagaccccttgttaaaccctctgaaagacttaaggtggtactagcagaccctttagctagacactgtggtttctaagactcttaagggtccaacaggagggaagaagagaaagagaagcctgtttcaactgaaatgaacctcagtcagatgcatagaaaacccataacattttcaagatatctgtatcagtgaaaacactgtaagtgtgtacaaaaagtgactgcaacttttcaaaataaaaacaggcctctgagtctccaattttctaagagcagaaaggctgaaaaaaactatgtagctataaatatcagccatttcttatgcaaacagaaggatgattaggagaggagaaccaagagtccagagaggaaagttaagagccatagagaacaatggactagggaatcactccaaggaagcagaattggacccgaatcaagggctgttccctgcccctggaagcagagggaattgacaacctgtgctttgctggattttgatgtttctatgaaccagggaccactaagtacctccggttcctcccctttttgtctgggaatgcctattgcgaatatcctgtccctttttcatctttatttatttatgtttgagacagagtttcgctctgttgccaaggctggagtgcagtagtgcaatctcagttcactataacctctgcctcctgggttacagtggttcttgtgcctcagcctcctcagtagctgggattacaggcaggcaccagcacgcccagctaatttttgtgttttcagtagagttttctccatgttggccagactggtcttgtactcctggcctcaagcgatccacccaccttggccttccaaagtgctaggattacaggcaggagccacactgcatccggccctctttttcatctttatatgttgagtatgggggtgagtagtaggagctgcaccttatgaagcccatctgcctctgtccctgattcagaagtgctatcaactgaattgtctcttcccaaagtcataggttgaagctgtaaccctcaatgtgactgtatttggagttaggccttttaggaggtagttgaggttaataaggtcataatagtggggtcttaatctaatagtattggtggccttagaagaggaagagagaaatctctcccttgcttcatggacacgaaccaaggagggccatgtgaggacacagcaagaaggtggctgtctgcaagccaggaaatgagccctcactagaacctgaccatgctggcacctggatcttggactgcaagctccagaactgagaaaataaatttctcttgtttaagccccccagtctatggtattttgttacggcagcctgagctaagacaagaactcaaggttctgaacatgaagctataatggcatgagacattttgtgggaggggagaatgagcatattttgaatgtggaagaaatgaaagtaattgtagcagagagtggaccaaaataagcttaaaaacatggccacaatattttttagtcccttccattaaaaaatagtctactttcctaagctgccttgtcatctgcattgacatgcagaatgtggtggaagtgatatcagtaagctctagagtgtggcaaaatgttaaaaacaacccaaatggccatcatcagggggctggctaaataaacaatgatgcatctatatctggaatgcctcagcactaaaacaatgcctcagagcattaaaaacaatgaagtggatctgtttctatcaagatggtagtatctccaagacatatggtcaagttatgaaaacaagttgctgaatgataacttcaagtaagataccatttatgttaaaatataagttcatgaaaagataccatatatagttgtcccttggtatccacagggtattggctccaggataccccttggattctaaaatcaatggatgctgaagtctctgatataaaatggcatagtatttgcatacaacatatgaacatccttttgtgtactttttttttttttttttttttgagacagagtcttgctctgttgcccaggccggagtgcagtggtacaatctcggctcactgcatcttctgcctcccggattcaagcgattctcctgcctcagcctcctgagtagctgggattacagatgtgtgccgtcatgcctggctaatttttgtatttttagtagagactggggtttcaccatgttgccaggctggtcttgaactcctgacctcaggtgatctgcctgccttggcctcccaaggtgctgggattacaggcatgagctaccgtgcccagcccttttgtatacttttaataatttctaggttacttataatacctaatacaatgtaaattctatataaataattgttatactatttatattatttataatttttattatttatatttatatgatttatattttaattttgcattgttattttgtattttttctgaatttattcagtcagtggctggtcgaatccatgggtgtggagtccaaagatatggaaggctgactgtattttcctgtacatagtgagtgtgtgtgtttttatgtttgtgcctgcacacatacactcgtgtgtgcgtaagatcattagaataaaataataagttctactcaataaccccttccagaatctggcctggggttgacattattctccctggcccttggttagtggaaaccacagcttcttctcctctgagggtgcttcccttgagtctagggtgattcctttatggccctgggtgctgtcattggttcttcctgccaccatggctgccagttccttctccttactgtcccttctccctctgcagctggaagatcattctcgttgatccagaaggcacaggtgctcccaagctgtggcgtgtgtgggtccctgctatccgtcattggcaggacttcagcgtcagcctaggcctccattccttaggagcttcttgccattgtgtcactaaaatgtcacattgtcttgtcctgagccgttcttgtgaggagccagtgcaatgcagaggggaacagaataataggattggccctttttatggccctacagctagctgtgcaacctcaggccagccacttaatattccccagcaaatcttgctttttatgaaatggggacaggagtgtcttgctcctagggagcaaatgtgataatgcaggtaaagtgccccatgcaatggcaggcgtgctgcaggtgcttgcaaaaggattttccctttctgcccctaattccagtgtggctgtaaatcccttcatagctgtgtggctttgggcaagtcacttaacctttctgaaccatacctgtcaaatggtgataatgacatctcccctacaatgttcattcattcattgagcaaatatttatcaaggacctagtacgggctgggcatcatgctaagcattagggatatagtgacggatgagactgatgaagtctgtgatttgatgttgacgattgcctagtgagaaagagaaataaaacaaatgactgtatcgataattgtcatgagcttggagttgaagcaataaaatatgttgtacccagtaggtgcttcaggaaggcagccacccatcacctactgcagtcccagccacaactgggctgcatgaaaccactactggagccccagcagagagctcacttccaccaccctgcctgtggggctcagctcagcaatgctctggcatcttctatattgtcctgtgtgatttctcagaagaggtagactgtcccaaaggccagagcactgctgctgtctgagcagccaagatgccgaagcttcatctcaaactttcattatcctttgccttgggctgtcctgttttcctctcccctcccccctcctttttccttccttctttttcttaagactaggtcccattctgttgctcaggctggagtgcagtggtgccatttcagctcactgcaatctctgtctcctgggttcaagcgatcctcccacctcagctccccagtagctggtactacaggtttgtgccatcatgctcagctaatcgtggtattttttttatagagacatggttttgccatgtttcccgggctggtctcaaactcctgagctcaaacaatccacccccctcaacctctgaaagtgctgggattacaggcatgagccattgcacctggcctgttctgtttcttggtggggaattaattccattctttctaggatttttttttttttttttaaatcttccttgctaaaccagagcatgggggaggctcccagggacccctcattcactatcattcagagtagcaataaccatccattaagcatgatgctatgccagggcactttaccctcatgaactctttgaatctcacagcagccctgacaatattataattctcattttacagagaagaaaatggagaaacaaagaggttggttaaagtgccacagccacacggttggtggctgtgtttgaattcaaacctggacacctgttgccattctgagggtgttctgtaataacatgcctgaatcagagttgggaagatggagcatgggatgaggacaaaggagagaagtccagaggctggctagagatggtaagagtccagagacaagaccctggtgttgctgtcctcagcctcttttgagaagttcctgttatctttaggggaagacaggaggggatggagaagagaatttctgggagacctcttgaatgtttcagttccaagacagtacctgagaagtccactgtgaacagttgcccacgttgtggactccacagctctagatgacaccattcacactgttgtcaatgagaatagactgtttaggtaccctgtagggacatgcattttgcatcctgtgtcataagaggacttctaagcggtactggctagaatgctgcggggacagggagaacctttctcaccttagaacagggtccctgggctcctgctggggagaaagatcagaaagggacagtccacagcaggccattgagtctactgggaagaatgagatgggagatatgggcactgtctctcctagccagcttttctgggtctctttaccctattcagacacacctggtggtctcaccctctgctccccatacatgaggctgaggtccctgcacacccaaccctggaattggagctggagctcaccctccctgcagggatgccggctttcagggccctgcctccagtccagtactgtgagtagcttctctgtccgctctcctggatggcttcttctggggacagcttggggccctaacttgcccatttcccagaatccttcctgcaaccaacttgagagttaaggtagctcagggtggttaaaggttaatgtctgcccagccatttatctgctttgaattgacttatccctaagagtgtggctctttaaaatgcaggagagtgttggagccaccaaactctctcattgcccagtgtcctcccccacccacccccctgtataaatccccagtccccctccccttccttgtcaggaaccgatttcagcccacaatggagatggtttattacagctcacttcctgctgtgagtaaataagtttgtctcctttaaattccctgggcaattaggagaatgaaagactgagctttggattagcatttatttcctccaaacgtttatatgaggccattttcccactgacaaattgtggggcaaattgttctcgagaaactgtctgcagcaaaggtgctatgattaaacggccggtgtaaatttggggtcataaatcctttccctgagttaatgggatttattcacagcaactgccattacaggctcaaagaaataataataaatgaggttgattttgcacctgtttcagggtaattaatatgcacactaaagggaaaagaggttgtttttacaaactgcctcgcctgtggctcaagatttggagtccttctggagtcttcaggtcaatggccagcctctttcaggacagagagctgggagcagttgggaaggggcttgaggcagggagagggtggtctggggtgtgacctgagactcttgcgttgcaggtaacggaacctcctcacgctggcttgagtagtagggtttgatatgagggcaagggggtgagtaagacattcatgaaactcaagtgtggtaatgttatactgaatacattggttgcaagtgacagaaacccaagacagctgaactcctaggactgaaggaagtgttccaggaaccccgggccccagggattggaatggagactcgggaccaccaagtctttctctcttgttctctttcctctctttctctctcatctctgtttctctttgttcttccagagttgacgccaaagttctcctagatggaaggtcaaagtgcaaaaccctcttacattctctagtctccctcacatgggataaagggggtggtggttattcctgaggcaccctggaggggcccagcccttccagaccccacttcaagctcatcctggccagaaggcctccccctcctctcaaggaagccactcaccttataccatccccactactggcaccactgcctgccattttgtccctatgcccaggtgacctgtcttctgctcacagagcttgcccagctctccagccccagtgttgcagcccaggatccctccccagccctggtcggaccgctccctgggaaccctgaccctgtgactccagctactgcctgcagtattgttcccaatggattccccctgaatcctgggatctgagctacactcaggtggggcctccttggaggggcatttggacactggacttctgattcgaagcaagatctgatcccctctgcctgtttctgttctgtctggtcccgttctcctctccactccctagggagggcctgggcagttgaggtcctaaggggcttctcactagaccctcataggacagcagctagagcaatctgtccaaactcaaattcaaccgccctgttttcctgagaggcagtggaagtacagtgattatgagcttgggccctggagctcgcatgcctggctttgaatcccagctcactgcttcctcgctgtctgatcctggccaaatcctttcacctcttggaggcttggtttcttcctcctctatgagatgaagatgacagcagtgcccagcttgcctgtttttttaaagtgtaagtgagatggattttaggcctatgccttggaagaaggagaagggaatggtgaaggagcggaagtgggagtgtctctgatccttgaagccttactagaaagacaggataactggctaacttggattcagcccctgcttctagaagctccttaggaagtctggagagtggctgatccatcctggggcagctagagaagcactcatggaagagaggacatagaagatggggtgttgtgggtgaataggagttcttcaggtagagccagggagaaaggacattattcctggcagagaacagctcatgcaaagtagtagagaaagagcatactatgtgttcagggaatgacttggagtcagtgagaggccctagagggatgtgttagttcaaatatgacagaagtatctaattagatcttttccttaaatcaattaaatcagactaacccctatcccccatccattgaattagcaggaaattcaatttcagtcactaccaaggccctgacccttctggggtcccaaatccaggtgcatctggcaaatcttctcatctgtactccatgcagctgccacagctgccatcctgtttatctgagtgcacagaggttcctgaagcccatgaccctctcccacgaggcccaacatctgtgtccaggcgggacatgccagggcctggggtcttgctcagtgcatggtgtggctgcctcttgggtgtctggggaggacaatgagttgtgatgagtcctcactcctgtcttgtctgtgtagcctgggaataattcctcctttttggcctaggccctcttttcctgaccctctggctctgggtcacccctccaagtcttttcagtggctctgagcttactataaaagccaggaagaaaatgggcaaatgctattttttgttctacaagatcccaagagcaagggcattcaaaaggctctgggtacccgttcaaaatgtggagaaagaagagggaacatgcacaaaaatcaatctctaaaaaaattggctgggcatggtggctcacgcctgtaatcccagcactttgggaggccaaggcagatggatcatctgaggtcaggtgtttgagaccagcctggccaacatggcgaaaccttgtctctactaaaaatacaaaaactagccgggtgtggtggtgggcctgtaaactcagctactggggaggctgaggcaggagaatcacttgaagctgggaggcggaggctgcagtgagcagagatcgtaccactgcactccagcctgggtgacacagtgagactctgtctcaagaaacaaaaaacaaattatgctgccatggtatgatgcaggaggatgagtgccgtggtctgaatgctggcattcccctaaattcatatgttgaaccctaatccccaatgtgatggtatgaggagatgaggcctttgggaggtgattaggtcatgagggtggagccctcatgaatgggattagtataaaagaggtcccagagagctgtcttgccccttttaccatgtgaggacacaatgagaagatgccacctaagggccccatttcctggctcatgcctgactccaaatctgccagtgccttgatttgtactccctagcctccacaactgggaaatgaatttctcttgcttataagccacccggtctgtgggatgttgttatagcagcccaaatggactacaacatagcaactgagcagggcatgatagctgaagcctcaatctgcaggggtttaaaagtcaggctatctagcagtgaggacttgacccagctaggggaaccatgtggtcagatatggggcttagaggtggagctgaagaagattctggaaggatcattttagtggcttcgggatattatagtctctgagactgttgatctctggggcaaagacaaagccagggcttaaggtcaaagctcttgaagctaaatcctaaatccctctgtctttctcttgggattatcctgggagaatgctggaataatagagatacccagaggctacttttgccattctgtatctgcaatatgtgttgatgtctcaaatctcctgtattagcttgctagggctgttctaatcaagtacaagagcctgggtggctgaccagagaaatgtatttgtctcacatttctggagtccaaaatcaaggttgtcagcagggttggttccttccgagggccaggagggaaggatctgttcagttccaggcttctctgcttggcttgtaaatggccgtcctccccctgtgtctcttcacctaggctttcctctgtgcatgtctgtgtccatgtttcttcctcttagaaggacaccagtcatattggattagagcccacagcaatgacctcattttagcatggtgacctctgtgaataattttttcttttctttccttttttttttttttttttttttgagacagagtctcgctctgtcaatcaggctggagtgcaatggcgtgatctgtgctcactgacacaaccacctcccaggtttgagtgattctcatgcctcagacccctgagtagctgagattacaggtgtgcaccaccacacctggctacttttttttttttttttgaatttttagtagagacggggtttcaccatgttggccaggctggtctccaactactgacctcaggtgatccgcccacctcagcctcccaaagtgctgggattacaggcatgagccccaccgtgcctgactattttattttattttattttatttttttttcgagacagggtttctgttgcccaggctgagtacagtggtgctatcatggctctctgcagccttggcctcctgggctcaagtgatccccctgcctcactctcctgagtagctgggactaaaggcatgcaccaccacccccagtcaatttttgattttttgtagagacgaggtctcgctatgttacccgggctggtctcgaactcctggatgcaagcaatcctcctgccttggcctcccaaagtgctgagattacaggtgtgagccaccgagttcggcctcaacttctgtaaagattttctctctaaataagatcacattctgaggtactggaggttaggacttcaacctatgaattttgggggatgccattcaactcataggacctccaaacaagcctacaaaatgcagaagtgatgactattttataaatgaggagttccaggttgagagaggtcaggcaacttgctcagggtttcaaagccagcgaggaatagatgggacttaaactctggtctgctgagctgtgctgcagctgggtgggtcccagggcccctgtggaggcagagagctggattcctgctgaagctggaccctgcttgtcccctcccctggatttttcccagggcaggcttcttagcctgctggaagaaggcagggaggggagaggagggatgtcattctgagcatcacttggccaggccttttgtctctctgttcattgcctgaaatgtgcttgcatcttattacccaagctaggtagatttttgcttggctgagctgagatcaaaaagtaatttttctttttgcaacagccaattagaaattcatttattttcacattatggacatttggcaaaaatttctttggcaatttagctccatttatatagtctgcataaagggagacagtgaggctaggagaaaaaaaaaaggcaaggccgcgggcaaaaattaaatgccgaatcatgtattagaaatgagatgtatttactattgtttttgaaaattaatggtgcatttttagcttttataatgtaatttaatgatgcaattcatctaataaaaaagaacacatttcaactcagtcatacagacctactggggcacagggcggaacaccttttccatggaaagggtttggaatgaaatgcttggggcctttctctttttctgtaaggcaaaaaaggaaaagtggtctgtctgtgtctgtctctctgtctctctgtctctctctctctctgtgtgtgtgtgtgtgtgtgtgtgtgtgtgtgtgtgtgttgccatttggagtatcagtgagaatctaataaaaaggacatttttcttttgccatattggtgtttgtgctgtgttatagaaatcagcctttgattctggaatgttagagggtgttggctgccccagcctgctaagccctagatggaaagaccctggtgggtggggaggagaaaatggccttggagctgtgtcgaggttggtcccccctggactctgagggggtgtgggcagactgggcatccctccggaggaattggccacacttgctggatttggaaccctgtgagcctcctgggtccaatgcatctctctctctttcaagtccaagggcctgattttcacttgccattgctcccaattttgaattaaggcaagaacgtccctcttttcgcaaagaggatgactggaagagaaacgagggcagggagggagggggaggcagggagggaggtgaggcaggcaggccctgaccgagctcctagggtgagttgggcacagtggccactgctttgttgcgctcccaccctgccactagaatgtcagctcttgaggatggagtacatttcctgtcttgttcataccgatccccagccccacagtataccatatacactcattagatactttttgactgcagagtggcagataaaccctgggttaaatacattatgtaaatgtctgcttaactctcactccaataccatgagaaggtgggtaccacgactaccttgtttaataggaggggacacattggctcagacaagttagggaactttctgaagttcactcatctgttaagtggcagggctgagacctaacccatgactatctcactcccaagtacttgctcttaaccacaccaatgtatgcagtgaatgaaagaataatgttaagtatgaatgacaggagggctggcctttctgaaggttaccaaaccaaggggctgggatttgaattcaaattttttgattccaagttaagaacttctttctgggctgggcacagtggctcacacctgtaatctcagtactttgggaggctgaggtgtgcagatcacttgagcccaggagtttgagaccagcctgggcaacatggcaaaaccccgtctctacccaaaatacaaaaattagccaggcatggtggcaggtgcctgtaattctagctacttggaagactgaggagggagcatcacttgagcccaggaggttgaggctgtagtgtggaggattgtgccattgcacaccagcctgggcaacaggagcaagactgtcttaaaaacaaaacataaaaacaaaaaactttctgctaccctatgtaccctcagcaggagggaggaagctgtggataggaaaaggagtttggcaggagttcaaggttacagtgagctttgatcgtgccactgcactctagccttggtgacagattgagaccctgtctcttaaaaaaaaataaaaagaaaaggggctttggggcagggggaagatgagggccattagcgtgggaggccaggggacacataggcctaggggtcttccaggcatggcgatccctgagggaggtgaccagggatagggtatatagttatcccaggggtcaaaggaaatgcccaaaccatttgtattcatttgttcagtgattatttactgaacatctatcagatgcctaggactcacctgaccttttgcagcttgaatttcctcacttgtaaaacaaggtgaatccttcaaagtatttcttgacaaggcgcactgttggtgttttgaatggaacaatcttactcctcggtctgaatggcacttccccaccctcccacacacgtggtgttctctgatcatggggagattcctaaatgctcccagataccctcctcgaatggaaacagaggctttgtagggctgctgggaggactcaacaggacaagctgcaggaaggcgctgtgaacagcctggtgcacaggaggcttgtcatgcttcctttgacatctccctttcccttgcctctctccctttctccttcctccagccccacaaatctgctctgagcatcattttgagccattgaccctgctgctacccagccaggctgtcagtcagctccctcctcctgcctccacctccctctgctcccctgtcctcgcagacctgcgcctggctgcagtccctgcacgtgggctcagcagctgtggacattctgccaccccagccaccggccccagcatgacccaggccctgccctgtcactgaaccttggcgggaaggtcagttatttccttcctttttaggaggagagctctgccctttgggtgcctgccctggtgctgtaccagcctcggatctgggatttttgcattttggggctgcctagagaagttgccaagcaggcatggtaaataggcctctgagtgtttggagtctagaactccactgtccgatttggtagccactaactgtatgtgggtcccgagcacttgcaatgtgaattggggtgtgctgtagtgtaaaacacacatggaatttgaaggctctagtgcccttggggtgcaagcagctgagtgtcacacctctttattttattttcttggatttgattcggggtggctgggcactagattggcccaatatcagttacataggatgatcccttcccctgtttgagccatgtaaatccataaacttggatatatcctcaccagactcccagagttgggattctgattgccagccctgtaacaccagagcctcttcacttccaaggagcagagggggcttcaaaagggaacatgcacaccctctccctcttcctaggtcccaggacttctagggaaaccctttccatcccctgatgcccagctgaagagccagggatggggatcgagggcttcttccgtggaatctcagagcacttgacagaccctgtgtgtttcattccagactttttgcccactgcccttcttggcctgagcccctggatggctgcacactgcccgatgcacttttgtgcctccctgggccaggcacaagtctcacacccagtggtgtggttcaaagtgaattgaggttgtcagttctgcagaggcatttttgcaaaggccctgcatggaggtgccaggtatgaaactgatttaaatcacatcctggagcccccaagcaggtaggagctggtggcagaagtttccatgtcttagtacaggtcctctgcctctgacacacatgctgagggacacctatgtggtgattcaagggaatcttgcacccactgggctctgtgctgcatgctttatacacatgtgctcacattatcttctcaacaactgtacttggtaaggctacaatgatcctcactttgcagatgagaaattgagctcccgagaggttataaaaaactggctgaagtcacacagctggcaagaggcaaaactagtattggtcctcaagttgtgtgaccctagaaccacaatatagcaattctgcttctcacaggtacacatgtacagacccaaagacacatggaaatacaaagacataggtatacatagatgaacatgcatatataaaatgcagagatccatatagatatgcggacagacatatatggacatacccacgttcccatggctactcagatataaaaatactcctatccatgtacccacattcatacctccatgtatactatgcacatacctatgcatacacctcatatacaaatatacacatggctactctgacataaaggtatacacacatgcacacactacacatatttgcacttggacatgaccacaaatatgcagagttgaaagtcccccctcctaccacacacacaagcatatagtgaggcttgtatacccagatatttaactcctgcagaaacacacacacacacacacacacacacaatcttgacacacttctaagaacgcctgcccccaggtatacagaacagcccctcccccagtatacactcacaggcactcactcaagcccaatgatccaatttaaactgaaaagggaaaaccaagttgaaaattagaggggaaaaaaaaagtccttcagaaagtataaagctaataggctgcaagtggtgagcctgctgccttcacgatatcaataactcagtattggatttccaaaaagacatcacataatttttcaatgagaaatccatgagccctggagatgctgttatggtgtgaattacaatgcacacgcttgtcagccgtccccgtcagcactttctcggatgccttaacgggcaggaagtgctgtggctgcagcagggatggttattgttattatttcttccttttggagcctcaaattaagaacctgggaagccagcaggtccctttctcctccctcccctcctccaattgtacccaaatcaagaagttttcctgcttgatatattctttagtgtattcttcagctctcagcctcccctcccctgtcctggagccctaattctgggagagactgacacctggggcttaggaactagggtcaggatacgtgggtgggggccaccctctctatggagctcgggcttgtttaagacttccttgagtgttgtggaaatgataaaaactgcttttccatttccgtcacttggacccagggattttttattgagcagaatcagcctattgggcattgctttctcctgaggttgccttcggggcaggactttggttcagtaagaagagcaggggtccctgggagggatgtcaggaatgatctggacagagggcatagggcatctttcctgagcatatttaggaggaatttgggtggccaagagaaaggatctgagcagaccacccaggagtaggaaaagggggcttgggcactaggggtggggttggggtggattgtggaaattgttttattcagctcaactctcctgggcttttcccattcaccatgaaaagaagatcctccaattagtcactggtcccagagtgtgagccccatggaacatacctgaaagtgacctgcagtcaggagcaaagccagtcctgctgactgcagacccacgagtattgtataccgttgagccacttggggctgtttgttatgcagcattatgaaacagaaatctgaggagcacagggacttctccgtaccttcatgactccctgggctgagcccactgtagcactgtggctcgtggtctagaatcacctctgtctctaactagtatgaggtttaggggttaagagtggaatcccagtctctgggttcaaattctggttttgattatagtattggataagtcatttaactcctttttgtgtcactgcccatttcatagtctcccgtttctccatgcatcattcgggtggggaccagaggcacctagccctcaaatcaggaaaagggtgactccttccctggcagccatccctccagcctgctcaacagccagactccagcttcacatgcctttttgtgcctccaggccatcggtcaggttgtccccttcctgaagcttccttctcaccctgacagcttctccagatcccttgaggcctggattcaaatgtcacctcttttccctgagcatcctgaagcagatgacagttgcccaaacctctccttgtcactcctggattgtgctgtgctgtggttatttgcttgttgccttcaggcctgggatgggctgggactgatcagttgaccctctggcttcttgccagagtttttagcaggagacacacagcatcctgtaccctccgtctcttcctcccctactgagacttgatgcacccctcaccaagggaaggtgaactgatcctgcctgctaagttgctcagtacataattacatacctatcacggcatggggcttttcggtgtacttatcccagccctgatctccagggtgggtatgcgggatggaggcagggaagaagtgctgagcccttgcctgtgggaaggaagaggagggtgatgtcaggaggcagcaaggccctgaggaggagggatggggggtcacctgctgggtgagctggcctggggttccctgggagcttgggcccttcattaacagtttgaggcacggagacctcaggtctggacttcttccaccactgactcacttcttgtctggcttgaagtctacattcaaatatgttgtttcctttccctgagcatcccaagcagatattagccctgcacctgaagctcccaagttccctccatatcttggtgacactcaagtaccatactctgaaatggcggggtgggatggggggcatcaaaagacactagaactttgatttccagttttctacattccataggcaagtaaaataaaacaaatgaaatacccagaggagatacccttatgtaaagagcaggccatatcttttctaagtaatgatgtataaaacagctgtcttcttttattattactatttcacaaaagaaagaatagtttaatagtaaaaactgggagaaagatatggtctcagaattaagcttctcccaagaaaggagagggagcaatggtgcacaaatgtgaatatcatctatattgtggagaagatgttagagcaaaagagaaattgctaaagtattcaacagagaaatatcaaatgcccctaaataaaatgtatagattggaggaagaaattttcagtgtgtgcagaaacgatgatgatgatgatgaggatgaggatgatggaggtgatgatggtaaggacgatgatgatgaagatggggtggtgatgatgaaggtggacatggtgatgatgatggtgatgaagatggaaatggtggtggtaattatggcgatgaagatgttggtggctgtggtgatgatggtgctggagatggcgatggtgatggtgctgatggtgatgatcatggagatggtgatggtgttaatgatggtgctggagatgacagtggcaatgctgatgatggcaatggtgatggtgatgatgtctgacctttgttgagctcctactgggtaataggtactgtactccatggattatcttatttaagacttaaccccatgtattatattcctgaagccgctgcaacaaattaccacaaactaggtgatgtaagacaacagcaatttattctcttatagttctggagaccagaagtctgaaatcaactctgggctgcactccctctggaggctgtagggaagaatgcttccttgcctcttcagcttctggtggctgccaacattccttggcttccttggcttgtggccacatcacttcaatttcagtctcccttttcacactgccttctcctttgtgtatgtcctcttctgacttatataaggacatttgtctctggatttagagcttattcaagtagtctgtggtgatctcatctcaatatctttagcttaatttcatctgccaaggtcttttctccaaaaataagataatattcacaggttccagggacatggacatatcttttttttgaggggtcactgttcaacccactgtatcccattttataggcaaggaagctggatgtcagattctttaaactaggtaaaagttgtacaatgatcaaatggcaaagaaagaatctgaatctgactctagagccttgggacttcatccttatggagacagggtaaagaagagaggctgtgtggaacatttacctcccatctgtgtgtgggggagaggaggtgcttcaaggccatgtcaagctcttcaaggccatgtgatgtaggagggctggatttggtcttaggtaacaggctccaaggtttagagccagcaggtcacaagcagaggaggtaggggttcggggggtgggggtagttagagaaagggcagatccatgatttgggggacttcttagggagcagaattacagagtgtatgatcatgtcaccaagcccagatgagagatggcttagaggagagcagattatagaaatcgagatggaaaatggggaagggataaaaatgagtcaatttggtctaaaagcagtggacaaagaatccataatgtatgaggaagtaagtagatatctacccatgtgtcatttataaattctttctataacagagcacctacctggatcacatgaaaggatgctaaaatttacagaaacaggtaaagaggcatattttgggggtaaagaacagcaatattcatttgctctgtgggacattgctcacatttactcacagtagcttcctgtgaatacttacctgtctcctgtgagatcttatgggggcagggtgggcagagtcaacttagacatgttgaaagctgtccacacttcttccctctggggctggaaacctcagcttgagaaggaaaggagagagctgggtttataacatcttgggatggttcaagaaggagctcacgcctgtcttatgcccagggcaggtgtgatctcttctgggtgtctccctagagactcagttccgcctttggggaaataagatgtcaatgccatggggcatatgtgccttgtccatgaggcatgggtgccctgtccatggaacacaggcactctgtccatggggcataggagccctgtccgtgggacacaggcaccctgtccatggggcataggagtcctgtctgtgggacacaggcaccctgtccgtggggcatagtgaccttgtccagggggtgatgctgtattcgccttgtcttcaaggattctgatgcctaccacagcagactgcagactttcgtttcagctgaaacgtctctacctttatgtgttggttttcacataagaatttatttaagacaagagatgaacaaagtttccagagtacagcatgataatgatctgtctgggaatacttatttttcctgcgtgaccccaggcagacctagggcctatccagtgtggtcacatatagttacaaaggccatgccctaatagcccctggggttccccttcacatgtcagcaatgtgaactgcaccaccaagagatgtgaagtgtgctggtcctggatctgcctctagctttgactgtgcaccccggggtccccaggcttggtgctccctctagtggcagggtagttgtggtctgtaagctctcagtcttgtgatgccatcaggagctccagaactgggaacaagttttggggagcctgcatccctggtctgacttgagcattcatgagttcatgcccgtaataaatactgagcgccttactgtgtgctggcattgtgcttatcacaagaagaaaagatccctccctcccgaaggagcatctaatctactgggagaaacagactatgaggaagaacacgaataaatgtgtgattaagatttgtgaccaatgctatgaagaaaacaaatagagtgctgacatagagacaaggggtgggggtgacaactgagacagaggcattaggggaggcctctctggaaggtgacctttgagctgagatctgagggatgaggtgattgcatgagaagaggtaggtaagagtgtcctaagcagaaggaacagtgagtgccaaggccctgggacagaagagggcattgcatgtccaaggagccacaggaagcccattatggttggagggtcatgggtaggagggcctgaagcttcagaagacatccagatgaggctgcagtcaggtggatgcaggcatccagatgaaccctcgtgctctgtctctgaatccctaccagtggaaccgagtgtgaggagttaggggttagcagagtgttagagggagcctagagaggagggctcttaacatttccagggaattaccaaatgtctcccactgagctgaggagattctgggccgtctccaaaagtatattccagaagggaagctaccttaacattagttaaggtaattctatttcctgtaacagaaccccccgccagatctcagtcacttaatatcctagaagtctaattctcacattaagtccactttggtgtttggcaggtgactttctctgtggtgatgcagggacccaggcacccgccatcttttagctctgccatctcttaggatcttggagtccttcccttccatctggcgagcagtgaaaacagcatgtagagctttgcacaggaggtttttgtggactgggtttagatgtgtctatgacttgcatttgggtgtggccaagtaatccagttactgaattactgggaaacagaatctacatggatgccctccaggtagaggaattgggtgctggtgaacacacagtcatctctgccccaggcctctctttgagtgacagcaacagtatggaccagaagctttgtgctgtggcttcacattcaagccacttgggcggctgccagcctcctatcccaactgattaaatcagattccccgggaatggggcctgggcatctgtattgttgaaagcaccccaggacgttgcagcacacagctgaggttcaggaccaccctgaatggtggagagaggagcttctgggacagcagtcacagctgggcccatccttcttcctgctcaataatcatcattatgccttattatcttcttaccaggtgacaggctagagtggcaggaaggaagacaaaagaagttatttacaaataaaatggtcggtcttccgcattctagggcaggggctgccttcatctcaaatgtgggaggctctttggcagtgggcaacaactttaatggctcctcatggttgagacaggtgaaccttaccttggcaggtctagatggtgagagcaggagaaatagataactccattgttcagcttgggtagaattatgagattcccaggaaataatgtgagaaagagaaggtaagtgttccatgttaaaagagtagaaggaagatgtcagagagtgggtcgggggtagggagacagagagcaagagcgagtgagagacagagagattgagtctatggtaagcagtcatggctcatggaaagaggggacaatgagaaattccctgtggcaggaatgaccaatatactcctaggaagtatcgtgtccagcattaaatttgaagttgttctttgttctataattgttttcctacccataaacgtttaataagtctcctatgtacaacagccttgtattaatgaagtcttgaaggactgaaggaaggaagaagtgtgcaagttagagttcttatttagcttcaggcagggaaaaatggaaaaatggattctgactaagcagcagaggaatttattattgggtaagccagtgacactgtgacacagggactcatacaagtcacccttcaaccactgggtggatgtggctggcctttagataacctcttactcggtctcttcaaaacatctctttccttccgtccttctgatatgatgcgcaagagcagatgagggcagggatggcaaacgtgagcccttctacttcatccttggcagacatcactaactgatctctgtgcaagttcttatggagctcaggggcagctccctggaccctttatatttcctgttccgggcagtcattactaacagatcacagatgatatgtgaaatacaatttacttctgttccagggtccatatgacacctctttcaaggcaatgtgtgtgcaatttaaatgacactatctgtctctcagcccaaagcagctgaggattccatgtcccagggacaaagagttgcccatcctgggggcccactgctacggatcttgcagaaactcaaaggctgccattcattcttgggatgctagtcttggggcagagcgggaagacaactcgcttgggtgttacaacctcctgaccccagcttcctttggaatgtggcaccccaagcctgcctctcctgactcccagtctgtgggttccactctgctctgatttcatgatgcatcctgacttcatgggttctaaaaacaattatttgctagctttgtgcccaccccttactttcaatcaggcccagggtggcagagagtcatggggctgccagttttggccaggctggactggggaggggatcggctacccctaaaggaaaagctcttccagccaggaattgcctttctcttcctaatgtgagataattggtttcctttttacctagttcctccacagccttcgtaattactgccaaacccttgtccctcgactttggcattcccaccaatggacttttttccaaagggaaagagaaaaaggcaagaagactcagaatgaaggcctgggctggatttacctcctgagtcatcacctactctctgtgtgaccttgggcacgttactcacttctctaaattgtcctccctaactaacagcttcctgctggaattttgagaggatgaggtgatttaaatgcttagctcaatagcgcatggtgtggctaaacactcgggtgaatactagtattgtttcttgttacctttgtgcctggtggtttgggctggggtgtgagggtcaggctttggggtgctggttggggacttgtgccttctctttttctttccccaaagcttctggaactaagctctccctcatctcttcaaggaagatgtgacaccaagtgtgttttagcagaaacaagacccatataagtgatccactgaggggccagcaggctaatatgatgttctgaaaaggggcattttattttgtcaaattgctctggggctgctgaactttggtggctgtttcttggcagtgtttctggacatcttgttcgcaggtgatgagaggaagggctgccctgacatcttgtacaggtgagggggctggaggcttccttcctgcgcgttccagccagtgccccgcctgcagtgggggagacattttttcacccggttcaatgtgcgggaggaggagggtgaggtgggggcatgggtagaggggccagtgggaggagtcccccccacagagtcctctgttagaacaacccagaagtccccctccccagcttggggagcctccagggcccgttcccaccccagcagccccctccccagctgggggaggctccagggcctgttcccaccccagcagccccctccccagctgcgggagcctccagggtatgttcgcaccccagcagccccctcctcagctgggggagcctccagggccggttccaccccggcagccccctccccagctgggggagcctccagggtctgttcccaccccagcagcgtctaggctcgcttcctgtctccccgttttcttaaaagctgtgtgtcagcacaggagtggcaggtgtgttaactcccggagcctgcgcctgtgccccagcatgggaagaaaaatgccgactcggagagaatcagagtcaggcgctggcactagccttgggggcaggagagagttggtcgaaaggaagtgttgggagaaggccaggtggctggtactgaggtacccacgcctgcttcctctgccaggaagagagaccccccactaaggtaactgtgagaagtagggcactgtctccctccctccctccctccctctttccctctttccctttttttcctttcttccttccctcgtttcctcccattttccccctccctatttccattccttttttcctttcctccctccctccctccctccctcccttccttccttccccctttctctccctctcttccttcctttttgccctctgtcctttttcccttcggtccttccttttttgttcatttctgcactccccctcctccccttcctttccttctctcctcttctcttcctttccctctctcctattctctcccttcctcctttccccctcttccttctctcccacctcccttccttcctgttttcctcatttgcatccctgcttcccctgtgctctccctcctgtcctccctcctcttttcttgtctctttcctttctcttccccttcttcctctctcctcttccttcctccctgctcgcaccatgccactcaatgctccaagctggacacagctgcagggaaatagcctcagccctggcccccaggagcttccacctagtgggagccaggcaggtggacaggtgatgatcctgtcacgtgatccacatgctaatgaagatctgggctggtctcctgggagctttgctgggtctggaggggtagagaaagccctcacagagcaggagacctctggcctgggtctgatagtttctctggctgagtcaaaagaaaggggcattgtaggcagagggaagagcttgcacaaagtagggggacatggtcaatgaattcttatgcaaatttggaattggacaagcctaggcttgagccactgtcagtataacctctgcccaatcatttcagcctctctcagcttctcatctgtaaaatggggtatgttagtactcatgatgccctgggatgtttggggaacagaattagctcttgcatctgaaaatatctagcactatgtgtcttatcacattttaccctcatgtcaacctggggggccgggtacaattatatcttaattttacagttctggaaatggtggctcagagaagttgagcagcctgtccaagttcacacagccaggtagattgaagacacaaatgtaggcagcctgattcccaagcccgagtgtttaataacaatctctccaaagtcagcacatacacttggaataaaactaacacatcaggtgcctgctctgtaaaatgaggttgcacaaacctggcaggatgacagggataactctccagagctggaggggccatgggggatgcacttttgatttttatggcttctcagggtcccaccaattgtactgtcttagcctgtgtctggttggtgcaggaaaaaggaggatgggcagtggagcaggaggaagaagggggaggaagagcgagggaggagggtgcattggagggagcaggaagaggaggagagggaggagggagaggggaggaaggaggggggaggaggaggatagagaggagaggaggagggaaaggggaggaggaaggggaggaggaagggggaggggagggagaggagggggaggaagagtgggaggatagaaaacgggaggaggggaaagggaggaggaaaaggggaggaggaggaggggcagggggaggaagaggggaagggaaggaagggaaggagggaggggaagggaaggaggaggaggaactctctgaccctactcccgaatctgattctgtccctcttttccagttccctgcactgaggtgttggaaatccagctttccagtggaggctgcctgggtttccatccttgtagctgtgctttttctgttcctctgggacttttcttcccttgaccccctttctttcaggagctcttggtcttgtctgaacagcttttgtctaagaagcctcacagactgccctgggcaccctttccttctccttgctctggcctctactgtcagtctctcctctctgttctccctctcttcccatccttccaagaaggtgaaccgtgggacttctgaggtctaaagaagggtcctggatagggactttaggagcccagaccggatggtcactggagagggacccttttgtcattatgtagactggccacacgatggctccctgggaccgtcaagcacctgcccagtctcttcagtgggcctctggtcgccctggtgattattctttcccttaaatgttccacacgcacctcttccttatctctgtagctgggcagccaacttctgggtttcctgctcaccctgggtagagagatcccagtcactggggcttgcgttagagaggagtggagtggggagaagagcaggaggggagcagaaagagaagtgaggggcttgccagggggctagtggctgagcagctgtaggaagggacttcgtggagttactgatgggctcagccaccaggagctgggctctggggaatctttaggagtgagaaacagagcctggatgtccattccagggccccaaacacaaggctcacttcctggaagcatgaggactggaggtgacacagaaaaggctggcgtgaacttccagacacctgaggagcaagagctcagagttccagctggaggtggcccggactgcagacttggccatggccagtggtggcccttcccggacatggcttggagctgatggagctgctgtttgggacagcaggatgtggcttgactcgggcactgaaaaacaaggctggcttttatgaaaaacaaacaaaaactcaggtgaccagagtttcacgcatgctcagaaagcagtggcaagttaggattataataataatgttataacaataataatgttataacaataataatgacagtagcaaataaccatctttttgaggatttatggaacatgtcagacactgcttttttttacatgggttgttttgtttacatggattaccccataggggaggtaatagaaggggatttataatgacagtcaaacctgaaaaggagacactttgttttagcacaacaagacccagggtacctgcaggctggagtgtggctttctcatgggctccaggtgattgcagggatggagagagaaactcgtccatttcacttgcagggtacacagggacttgccatcacaacctttttcatttccaaccattttcttcctgttggaaggaatattcctcagctgaagttggatctgatttaataaggcaataaccagagaaatgcatttcaattgattattaagcatttgtttattaggactcagtagctctgacccaaatagctgctaagcagtcattaaacatcaaagaagatgtttctgtttatatattttgtttatttaccgtcatgaacaaacattattgcatcaattaaatgtcgattagggggtctatggtttgaattagattatacacatagtgtcaaatcattttcgtgtctctttctgagatataatctatttttgttttagtatctaaaaggattccatctaagtgttagaagctgtggccggcaggggttacggggtggcttctgagcacttctaaagctgatgtttccttttttggagtttgcagcctggatccctgtgacagcctggaactcctgatccattcctcattgatcattcatgaaggggccatttctctgcgattctttgcttttttgggcattaattttctagaaaacaaaacaacacaacaataactctaacctccatcataaaacccttagatatttatctccaaggcagctaaactgagttgtggaaatgaaattaagttctccattaatgctgcttcaattaagcagcattgaaatcaggaatggtgtgcttgaaagaatatatgattttcctagtcacagtctagaagcattgaaataacatatcttaatatatttttattcaaaaaaattggataattttctaattatatgagacaactatgtgtatttataaaatcacatataaacctgagcttaattttttttaaattgataaaattatatatatttatcatgtacaacatgatatgtatacattgtggaatggtgaagttgagttagcatcctggctttttaagtcagaggagaggggacccgcaggaggaccctggctgaattgggccccatcagacccagaatggaacccccccggtccccagaatttgtcctcctgttgtactcagtgcgttggtggaagcagaactccccatgggaacaggcagacctagattttctggggtgggaggggaaggtaaaggtgcaacaaattgagatttctccctgccctaactcccaacccagcccagaaaagaactttgagtgaggccagcagtggggaggctgagctctggcagcctcaggggtcagtcctgcagggtagcgtgcggggatctggctctagccacatgggggctggcatggatgccatgaggctcagctacccctctccttccaccttgttctttctgggcaggggcagccctccagatcccagtcagggtttatccaggggtaaaggagagaaagaaaggtgagagtgaagaggagagtccaggtgagtgagggaacagcttgaagaggccagccatttgcatattaaagagcctctcggctggatgtggtggctcacgcctgtaatcccaacactttgggaggctgaggtgggtggatcacgaggtcaggagatggagaccatcctggccaacatggtgaaaccccatctctactaaaaatacaaaaattagctgggtgtggtggcacacacctgcaatcccagctactcaggaggctgaggcaggagaattgcttgaacccaggaagcagagattgtagtgaactgtgatcaagccactgcactccagcctgggcaacagagcaagactccatctcatttaaaaaaaaaaaaaggcacctcaagttctctaacgcttctagcccagaagttttcaaactttcttttaaatcaatggaactgttttatcaagtgacatcttatttcagtgaaagtgtagtatatatgaagtttaaacacagttgaagtggtcagtgcagggtgcctctcacttgccccctaagcactccctgccatggtacccagaggcgtttctgcagaaatcctcttactttgtagacgtgctttgaaaaccactgcattagtacactggacagccctgtccttaaaagctagtcgccagcccagcatggacaacagaagaatccctgggaatgagaccttctcaaagtcccaggcccacctatgaacattcagatttcctagatctggatttcacccaagaatgtacttttaacgagagccccaaatgattctaacccagtaggctaggctggaactagggtgaggccagcaagtgcttggaactgcacttacacggccttgagagtgaagcctcctgaaattttatactgtaggcccctcactggcctcactctggttctggcccaggtactaaccatgtgaaaaccaacacccagctacactctggggtttggctgcatacagaagtgctcagatggggcttgaaagaatgaatgaaagccatagagatctgcctcctggtgtcccatgggacagacagcaaagaaaacaggttgtaggcaatattcatagtcatttttattactgctattgttaggaatttattttttgatgcttgtaaggtacaagacacagtgggaaacaatttataaacattctcatctttcacctttgcatcagccatgtaatagttcaatttgtaaatggggaaacgaaagctttgaaaggtgaaagtctcgtccaaattcacactgctagtcgtgatgcctaatattctccatggcttgagctctttacctttctgctgtactgaggataggtatacggcccttccttagcatgggggatgatgttcctaaatgaccctcactaatataatagcatccattatggactgtagtcactgtgtatgtttgcccagcaagcatcctcatctgcttctctgaagcaaatctcactcccaccctggccacaggatcacttgatccaggtctggccaatcagaatcctccattgccctagaccgtgattagtctgggagtagacacggggtctaagtcagaccaatcagatgcctccccaggatttccagttaggagctggagaagctgacttgcctctggggtcactgatctggaaggaggtgaggggttgctcacagccagagctctaggagagaacaaagaagaggaagctggtgacccagtcttgttggcaggtccttcttcagttctatgaggtgcctgagcatgtattgctgtcagctgtggcagaaaatagttttcattttttactttaggctagtttgagttagttttctgtcacttgcaaccaaagaatcctgatgaattcagcatccaacattaacatcacagtccctctactctgagccctgtctgaaccacccgccatcccgctggcatttcacagtggtgtttgtgcctcctttctcctcccctgcagttcatgccttttcacagattggctgaggattctctgaacactattcactcccagaaagttcccaacaccacctgaatgcatttatcttttaaaaattatggtagaatacacacacaacatttatcatcttaaccacttttaagtatatttcagtggtattaagtttattcatactgttatgcaaatcatcaccaaatcctcatccatctccaaaattcatttcatcttacaaaactaaagctctgtacccattaaacaataactcccatcccctgcctaccctcctctctccagcccctggttactaccattctagtttctatctgtgtaaatttgaccattctaagcaactcatataagtggaatcatataatatttgtcctttggtgactggcttatctcacttaacataatgtccccaaggtttgtccatgttgtaacatgtatcagaatttccttcttttttaaggctaaataatgttccattgtatgtatataccatattttgtttatccattgataaacacttggattgcttctgtgtgatagctattgtcaataatgctgcagtgaacatgggtgtgcagatatctctttggcatactgattgaaattacttcggctgtatatccagaaatgggattgctagatcatgtggtaattctagttttaattttttgaggaactgccatactgttttccacagtgactatgccattttacatattttacattcccaccaacagtgtatgagggttctaatttctccacatcctcactaatgccttttttttttttttttttttttttgctagtagacatcctgatgggtgtgaggtagtcctaatgcattcttagtaatgacaattgtatcagttttgctccataaaaactactttaaaatcagaggcttaaaacaaccactatttactcaggtcatgattctcttgagttaggaatatggactgagctcagctgagtggctcttctggtcttggccagacttacccatgtgtctagggcaagctttgtgttgacttgtctaggaagacttcagctgggatgactcattggtgcttcatgccatctctcaccagaaagccaggcttgctcacatgaaggctgggcagagttccaagagaacaaactaaagcattcagtggaagtggcacaacattacttcctctgaattccactggtcaaagcaaatcaccaggccagcccagatttaaagtgtggggaaatctctgtctcttgataggagggtctgcaaaggcaaattgcaaagggatgtggatatgagaagtgaataattacaaccaattttttttttttttgcaaaatctagcataacaacttttcaacaagctttcatgtcagacagaaggaatttgcatttgagatttgctccaatgggctcacccaattcatgagtttcaaaggctgtggttcacacctgcaaaactagactatgctgggaattgtggaatcaaggctaatgcctgataatttcaaatgagaattttttccttctaaaatcagtggatatttctgaataaattgttctttcagtcacgaatcatggaggcaagagcttcaattctccattcatttgccataagcagttgactcaaggacagctctgactgtctagccctgtctattaatgagtgccattatacaattaacttttccatcacctttagaagatgccaagccagactcctcctcaaagcccacagtgaacaggggagcctccacggagctccatagcctgcttagatgttcagaaagtaaaaaccaactgaaagtgaaagacttctaaagctcagagctttcccagtaactggactaatggagagtacagccagatccaaatggttggaactgttgccagggaagtaaagggaagtaggtacctccaagcattttattaacctggtaaatcagtccctggaagcccactgggaaggtttggagcaagtttcctacttcgttattttagtcactgctactgtaatgctgcataacaaaacacctcaaagtcagtggtaaacaacaagcatttatttttctttcttatgggtctgtgggttggctggggttcaggggattttggctgggccaggctggactccagggaggatgtgggattcagatctgttccacagagctttgttctccttggagcagtggctctccagagcatgagcttcccatggagaataggaggagctcagagggcaagtaaaccatctgtgcccacatgaggcttctgcctggtcatgcgtactatcatcctatcagccagtgtgagtcacgtggccaagcaaaacatccatgggggtagagacataagcttctctcccagtgggagagcagtgcaagcactgcaagttacgtggcaaaagttgagatgtataatcttagtatggtggagtaagaattgagactgaaaacagaatctaccatatttacccagagggggttggaggttgaggtattgaggttaaacctatgttgtgtgcaagtgaagttttgtatttatctaggaatgtctgaaagatggctgggctgaatcagcaggggctattgaaatgaggaactgaggattcttaggagagtgagctcctttggggtaatagagaactgggccaaggagcttatccaaataacacaatcccagtccttgaagagaggggcatttctgagtactccatgatggaagtctctgttttttttccctgtatgacccctatccccaccattgactcatgactggtccctggggagagttgattattccaataaaacattgcgagatgttggggcctaagcaccattgctatgagtcccttctgggggaattaaacatggaagagggttttttttttccccccaaatcacaattcttcaccttggggctttgaacccctgtggccctagacatctgcagtgactgtggctggcagcgggtaggaggtggcatactcagtggtggcagaagcggtgtccaagagaagcaattgtaccaggggaagcaatattggtgcccacctatcaggaatggcagggatctggacaggtagggagaggcaagattgaggaacagggaagggtgtcctgcttggagatgtggcctgtaccctgggcacactccaggctcagcacactctctagcacatgcagtggtcccagccatattcaggctaaggcataatgcttaggcagcccttctatacttcaggaatgtgatgggttcatttattcctatcaggccatgacagggtttgcaaacaacctttttaacactgttcctttgttcattaagtatcaagtaccttctctgtgctaggtactatgtaagggatggttgaataggaaacattttctgctttgcaaagctcttcctcttagtgcaaagttgggtaaactatttcctgtgggccaaatatgacccaccatctgtttttgtaaataaagttttattggaatgcagccatgctcatttgtttacatattgtctatagctattttaacactatgatggcagcactgagtagttgtgacagagactctatggcccgtactgcctaaactatttactattggcttgttgtagaaaaagtttgccagtctgttgtctagtggaaaagagaaacataaacagatgaacagataaataggcaatgacaatgtagcgtgacaatactgtgacagaagtaagtgcttggctttggtgggaagtaggatcagggaaggcttcctggagtaggcaatgtctataccaagacctaaatagtgagttcagaaattttggcaaaggtgtggggagagattgccaacagaggaaagcatgaacagaggccagaggtaagagagaacatggggttttgggtggtgggagctgagagaagaggctgggaagagtgctggtagcatgttgggcatctcgtcgccattcaggaaggtggcatccatcagcggtgggctgtgcttggcactgtgctattgatatgaatgtgttctcaattccttctaggactggattttaatatttctactttacagatgtgaaatgaacatggcaataaaggagctggaatttctggaggcagggattttctggatggacgattcacgtgtgtttgccacatcctatgagtgctgggatgggttgtggttagaatggtgggggtgtagcctggccttgcctcattaacttgtggtccctgtgctatgcatttcaagacttgttccagtcccagagtgtcctgtgcccacactcagcctcctactggggcccccacctaagacagggctccttgagttgtgggttgagctccatgtctggttcttcctccttttcccatcaaacctgtgccttttgctctcaggctccaacaggacctgcaaatccacacttggggcaaagctccatgactcagggcagctaccctttaatgcttagtgtgaggcgcaagcatcatcctgccccttcttgtgctcagagcagacttgctaagggatcaccaaaccttcccattgaatccagacacagcctcagaatcctgctcaacacagccctccactgatcacccagcatacttgccatcctttccttaacccagagggaaagcttgagctcacgcagtactttctgcacaaacctagtcactgctcgcaggtagccagcctttttgtcaactctgattttgacccgggactcaacacaattcaacaaatgttcaccgagaatccactaagtgtcaaggagcagagatgaataaacatggtctcaatgccctaaggagctcacattctgatgagagacgttattgacttgagcaaccactgaagtggcagcctttctctgctttttctcagggttgtgctgaccgcacgccctgcagaactggactcaggcttccccatctgagatgtggctatgcctgggtggggctgcgtggctaggacttctgcatctcagaccagagggcagaagatgcagatgaggagggggagaggaccccactggaatggcagcagctcaaagtaaaggatgaggtcaggtttgcaccaggttaggatcaatgaacagtgagcctggcctgagcagtgggtacagcactagggtttctggaatcttcagataagctggtacactttgggactctggccacccattctctccaggcccagtgggggaaagagctgacaagcacaaagctacagtatcaggacctcagcctccaaagcagaaacagagcaagaaggaaactgaggcaggggagtagccagcccgactccacagcaggattgggcacacatgcatcaggagtcgtgcagatcaccaggcttaggaagacagcagctctaggaggcttgagggctgatttttctgatctactgcaccctgaccagcactggtttagggacgctggagagtgggttctccccatgttaggactcagtgtgagagctgcttatgactttgccaggttttttctttagccgctgagacatctctccaccccaggatctggcaatcacatcaatcccaaaaggggcacctaaagccttcaactatttgcctttctatggagatttccagaatctactcagttgatgccataaataggtagagaagggagtgtgtgtgtgtctgtctcagtctatgaacacacacacacacacacacacacacacacacacacacggagtcagacctccttcatcagaatcagtttgcaaacttcatttccttaggatgaagagaaaagaaaattattattaacatatcaatggcacctccatgctgagaacaagattaccctcagtacacacaagcgcccagggaagctcagacactgtattttaaatgtgctctgtttctgcatctccgtctcccccaccccacccccattcccttcctattttttttttttgttcctctaagcttgtttctcttgaaatttccaccttgtggttgtgtactgctgacttcacatttgctgtggtgtgaactccacatctgtgaatggatgacaggaaagattaatagccctgctctcttctccttgactgtgggcccagctaatgaataaataaataaataaataagcagagctccaatcccctaaatagagacccagagccagggagaaaacagcatttcgctgaatccattctttaaggaaaaacccaacctctaatgatctctgatttacatagtcggcagtttttcactaaacattttacaaagacacaaaagtgtggggtggagggatcgctccatgttctttccagatggaggcaggggtccccctgagaagcccacaggccaaacagggctggtgcagagtgtgggctagctatggaggtgagccggtttcccactcaggccgccttaggcctgggatcattgagtcgagcgatgatgaagagggaggcaaagggacccctcaggggtcccggtagttggtccccacacttaccaggtgggaggaaggtgtgggctcaccaggcagctcagaaagcctacgagtgtaaggggagggaggcagggagataattcatttcctcctgcttccttcatgcctccagttctggtgaaagagaagctcagatatgcgcagacagagcttctcaaacttgaatgtgccctaatgacctggagatctggttggaatgcagattctgatcagtgggtatagggtggggctgagactggccaattccattaagcctgcaggcgctgctgctgctgctccaggggtcacacttagagtagcaagatgttgcagaggcagcagaaagtcaggttctgccccctcctctgtggcccttgtctgaggcttcacaacagtcatccctttcctgccagccccagaacttggctgttacctggttttccaacctcagctgactccatgggtctaatatcccaaggtacctcagccaaatgcagcatacacatcctctctggaccaggcttggagaatttggctttcccttggctgtgtttgtaaagtatggttgttcctacctggtctctgcatctttaataaagtccatcattggatatgaagatgctgtgcctgggtgacctggttgaggggcaggtgggctcagtggcagcaaagacatctgtaggctctgattgggctgagcaagagctaggggtcaaaggcagtggatgctggaggggcagcgaggggcttccctgcacagccaggagtttgaggggcctgaaggcacacacaccagccatcgatcttaacctgctcacttctagtacccatcagctcacttcactccttttgatgatgaagcagagatgagactagtccagcagaaaccaggacaggaagccccacaatgccagccatgcccctccattatgatccccctggctcagcgttcaggtggacagtctcaggtgtggtcacatggggatgaagggagcagacaagttagggagccaagctgacccaagccctgacattctgttcttcctcatgattagcccggttgtcaaactcatcctggccctcaaattccagccgtgagtcagcctatgaaagccccaaggcaagtttatgattcacctgagtgtagctcatcttctctctggataatcctcagatgacccccacccagccagggggagctgcctttatcatcccatgggcaggattagccctgcacatccaaccaccatttatttgtcgaacctgtatttgttcacctgtgaaacgggtgaaacggggaccccaataccttcttcacggagtggggaaggtagaggagccaaccctcaaaagcacccaggtcagggtctcagtccactgtaaacatcccccaaccctggtagcaatcatgcctttgcattgccttctctttccggctgtcttctagctcatcacttccaggtgtgcttcatgaaacaaatctcatgagatattcacacagaaaaatctgtaacaaaaaattgggaaaattgcataatattcctttcttgaagagttagtctaactttacttgattctgcttgactcaaacttgtttggccatagaacctttttcttgggcataacatttattaataactggggtgtcaggagatgggagccagctgacatgcttcttctccaaagccttaacccagaaggtatgcctagtggcatctgggtagatctggccagctggggaggctgggttttgtggatgcaggttttccccactctagtcctaagctgtaggcatctttctcccatgcctatctcttgagtattctgacacgctaactccctggggctttagctcccagcacctgggcagattaggctgttcccttgcggagaaaggtgagaatttaaacttggagccacccagacaagcttaaccagagccccttgctttgtacaactcaggggttaatgcagtgtcacagcccaacccaggtcatgcctactgagactgatgtttgtggcctgcccatagccccttagcatttattgttgcaggaggtgcacactggcattccattgtaagcatttgtgactctgcaagagatatttttctctgtttctggggaatgctggacgtgcagacaattaatgcccctgggaggagccctcacccactacctgatggggtgtattagtttcctgtggctgctataacaaaatatcacagacatgatggcttaaaacaacaaaaatttattctctctaagtctggaggacagaaatccaaaatcaatattactgggcagaaagcaagatattagaaggaccatgctccacctggaggctctaggggaaagtctgatccttgcctcttctagcttctggtggctgctggcattccttgactcatggccacatcactccaatctctgcctccgtggtcatgttgccttctcccttctgtttgtgtcaaattttgctccgcttccctcttataaggatacttgtgattgcatttagggtccacctggataattcaggaaaattttcacatctcaaagtccttaattacatctgtaaaatcctttttttttttttttttttttttgccatataaggtcacattcgctggttctagggatcagaatatgatatcattggaggccattgtccagcctgatatgtaaaaggttggagggtaaatactccaatttccttgcctcttgggtaaggtaacaccgagagctgttctacactctcctctctcctaaaattcctcagagagattgagcctcagttgtccatggcaacaaactactcagcaacacactctgttgcttttctttccttcctgtctcacttctccactcttctaactgttgattcctgggattgcctctaaataaactacttggccttgaatcctcctctcagggtctgcttctggggaacccagcctaagaaacccatctatcaccaaccatgcacagcaaaggcaatcactttaatcgattaccctttggattcacaaagtctgggtggatgtgccctgtagacacaatgtttgcagttgtgagtgaggtagctgggccagcaaccccccagactacagtgttgtaaccacctcctctcaaagaagatttaatccagcagagggatgtcttcccatctgtgtctatcttgacatccacagtgaagcagaaatcttgatgggacgtgaagaacaccatggtcaccacagtcttttttgattcagagatttgaccttctccagactttggagaaagagaagccctggttaagccaaacagcttacaggggctgctaaatctgatgactgcttagcagaaaaaaatatcacacggtggaaggacatagaaccgaatgaatgtccagaggtgctgtccaggagccagggactagagtcaaaaaccttagaagtctacctcatgttctgttgtactgcagctgagctggcactcaaaccataagatgctatccttcccactcttccctcccctttccaaaggcagaagagcctcaccctggggtcacaggcaccacaggcccatggaaagtactgccagactactggaatattcccttaaggcccaagggctcttcagtcagcttgtgatgaatgctgcctggcctaggacttgaccttcagggcagtggactcctctctggtccagggcaggtccagaaatgccatccaagagccaagtcttggaatcggggaccccaacagcctgcttggtgctctacccaccctgtggctgagctggttcctgaagtgcaagacaaagtcccctccctttacttttccctctgcttttctcaagcaggagttaaggacgctcgatagccaccacagctggcaatgtgctgagtctcatctgaagccagcaagtcttggattcccacccaaggccctcagtgtagtacctgggtattgctgctggctattcagggccaaagggctcttcagctggtagttattgaatcctcccaggactgggttcttcccttcaaggcagtgggttcccatatggccctgggtatgtctagacatattgtctgggagctagggcctggaaagggggcctcattgactctgataggtgtcctgtcctgctgtggctgagctggtatccaacatgcaaaacgaagtcctccccacttttccctctcctctcctcaagtggaaggaagggtgtcttttggatccacaagctctgtagcctggggttaggggaggagtgatgccagtactccctcaaccaccctggctagtgtctcagtaggtcatatactcacccagtccactggctctgggcccagttcagcactaggactcacctaagagttgtagtccttgtggcctagactgcccttccaatttagggccccagagcactttagcctgcagtggcgaggcttgtggaaactcaagttgggatcactgggattggcaatacatttctggctagggctggtttagatgctccctctgtgggtggggtcagctaagtttggatccatttttctttctgctataatagggcagcactgaattcaatgtctcacaattgctgtgatctccctctccccagtgcacagtgagattctccataccacactgtcactgctggcggttgggaaaggggtggcatcaatgatttaaaactgtttttcttacctctttagggccttcatcagcgatgtgaaattcaaaccaggtactgtgagtgctcacttagtgtttggttcgtatgaaggtgcttttttttttttttttttttgtatatagttgttaaattggtgtccttttggggtgggaggagacaatcggtggagtcttctattccactatcttgctcttgtctatttttgtttttgttattattgtttgtctgtttatttgttaggctgtcacaatcttgggtcaagcctcatttcttttccctgggcctgttgtctttgtgactctaggctctcctctcttctgaacttctatcatagatctggccatgacaggacactcacgaaagtcctttaagtgatcctcactcttcaggacaaagttctgattcgccgtgagacttatgttgatctgtccgggcctacccctctgcctctccatgctcaactttccacctgcttgtgtgttcccctaaccttcgaagttctctgcaccagctgccatgctcaaacacaatacctgtttataactatgtgtttttgaacatgtcatttccttttcttggaataaatggccttacggactgagaaactttcatttgcttgccaaggcccacattggcagttatctacccttccctgttgctctcattgcagtttgtatatatcctaggaatacactttggacagaaattatccatggattccagatgtctggcacctcctggtcctttgagttctggataagctcggttggtgctcccattttatatctaaaatttaccccaaaccctcccaaattctctgcctcttcttccaagtgttatattttcagtgactcctccaccttgggcctactgccatcagaatttaagtcttgattaagactggaaaactcagtcttttctttgaggtccatgaacaacaccacatcttccaagcatttatgagtgcaccgagtgtagtagaactcaagtgaagatgtattttggggatgagaggttagcaccacagggaaatagtctcttccctaatagcctccaatccactctaccatcagggcttcagtcagtatcactgggcaccattttttctagctttttgtcttcttccatctcaccattttccctctttaaacctccctgccccctcttctcagtaacaaatattcccctccttgttatatgcagagaagtttgcttgttttcctttgttgactccttgcctcagtggcttattgaggcatttctatcaagacagtctgcccctactcccaggggtattctggtactagctattaagagatactcacctctgttactcttgggtgcttgtctatcatcaccaagggcctaggaagccctggaggatagagaagatgaagagaactagcttcattcttgtgggaatagttgtaaggatgaaatgcaatcttttcctcctccttcttcttattagatattgttattgttacttttcactcatcttcatattgactgggttgatcacacttgccactgtgtagaaccagctgttactgaggctggatgttcctctggcttttgtggccttgctcactgacaacttaccctcaagaaggggatcagagagccaagatgacatgtgtttgggagcagaaagctggacatgacatctctggctgtgcaggatttggaaagaccctgtcaacataggcactgccaggagctattttgtcttgtcctgactcagcccatacatgacaatctcccttgctcccttcgtttgcctgacacttctgagctccatctcagtgccacacttttcttgtgatcttcctctccagcacctctgccctgagtcaggcattaatagctcttggaagtgggtaacatttttattcccattttagagatagagaaactgaggcctagagatgttagtgaagagctgagacaaacccaggcagtttagctctgcattctcttcataaaaggtaagacaggctgtaataaaatggactgggcctttggccccgaggaaggaagagttgttcacatttgaccactggggccaaatgtgtctgagtagaggaaaaccccaggtgttgtggtggtcactgccacaggtgagtcagttggcagagctgtatttggacccaattctctccactccttgtcctatactctttctaatacaccaacctgttttactttttattaggccatccctggataaagtggagggacttgcctggggtcccaagattttgctgtgagaggtgagattagagtagagatctcctgcatcctggtctaaaactctttccaccacattgagctgcctctgcccaaggctgcgcccatctctttgcctgattttcattctctgcttctgcctcccctataagggcgctgcaaagactcaccaagacctttccaatccagttgccatgactgttagtgttatgcacctacagactttgtaattcaggttgcagagaagtcagtgtttgtctaacttttggggctgaagaggacactgagggcttgtctggggcatggggctgattggtcctatccaatcattgcctacttgtcctttgccccatctcacaaatatgtaatcaagtgataggtcaggctgttatctgattatgtttgttaagacccagataatgatttctgtttctttctctaccttcacacacacacacacacacacacaaacacactctctctctctctctctctctcactcactcacttctaggcaccaaagggctgtaggctttgggggaagacccatgctttagttctgggccttccaatatgatctgggattttggagggtgggcgacagggaggctgagctgtcactttgaattgcaaagcgtctattcataatgcataaagaggcccccgcaagtggccatagcctcctgtcgtcctgcagctcagggaaattagacagcttcagagccccttatgaaaatgcaatgtattaccgctgctttttcactagtaaattatgcattcgagagtgacaaattccaagatgccgcctttattaggaactcagtgcggggtgggtggacagtgctggctgccaagcttgcgacagaatgtttaataactttttctgactgtgcttcccggaggtggtgtttataatacgtatttccctcctctctcattttatcaaaacaccgatgctgagcttattgctctatttatgcatttggaacctcttcctgggtcaaagagcatttgaatgacaaaagcaacgacagagaccgtttttttaaccaatctgtctcacatgcctgtgaccttggtgttcttggttttttaaagatccatccatttggaggagtcagctgcttcctgaacttcaggccttgaggcaggagacagcgtgtaccatctcctgccattctgttggtaagtagagacctgtgatggtacccaggattcaaaagtcatcttccccggcgggaggcaagggaggcttatggagaacctcttaaagatattgtgagcattctactcattacttagggaaagacagcgggtgttggtccaactctggcttttgtgccaggtaggagttggtcctgaggccgcccatctgaccatactggacctgttttaaggtttttctctaaaaaaattttagatttgtcaatctgtgctcctgcaggggatgctatgtccaaatgtcccaggatttgtttttttctgtctttcctgagacattccctgcccagctacccaaggaatccttcaaacgagcaaatctgaccatatcttctatggtcagattaaaatcttccatggctccctattgcttatgggacaaaatcaaaattcctgagtctggtctaaaaggtgtttgatgatcttgacctgctgactttgccagccttcttgtcagactctcgtgtcatgctccgcctagactatgagcctgctatttcatactatgtagctttgtaagtcccagaaaatgctgggctctgactcttttataactttacatatactgttccatctgcctggaatgccttctacttgtctgtccagcaaattctcactcatctcttaaggcccagcttcagtgccgcctcctatcataagtcttccttgatttcccaggcagaattaagtccctcttaccccatctacccattgtgtttgtacatacattcattatagcaataatcatattagatttcaatgattggcttgtctttctccacactttatttttaatagaacacctaggttttagttaatgctaaacaaacatttgttggttgtctgtgtggcatcttgggttgcctgacagactcttggccaaatctgttcatgcatccaacacatacatactgaacaacttttgcagaccaggcactgctgggcctgaccttctggttccattactaacatgttagcagtgtcactttgagcaagttacttaacctctctgtgcctcagttttctcatctgtaaaatgggaataatgcttagcacttaatttttggcaagctagtgagaattaaatgggatgatgcctgtccagtgtatgagggatagcctctattagcccaggactggcacactggaagcacataataaatgctagctgcaataataataataataataataataataataatagtgctattattatattatatgcttatataggatctatttacaataatataaatataattattattcatgttacttgctctccttgaattgactgggcctccaactttccctggctgccttgccctacacttcgcagatgggacatggatcattttaattagattttattgggctgttatatgggtcataattgaggccattattcattttcatggggctgctgacacagcctcagtttagacatgatgctatcttgacgagacaagtccccatctcaaaggatccctatttgaggggctggagctgccacaggaaaagagtccttccgaggccccaaacacagattctgaagagattaatgccaggagtgttcgtcagagaagaggagatttgtgggcgacagtggcacccttctgtgtggttgttggggccacccctggggagtggggcattcatccacttggctgtgtgttccactctcaccccaggatctccagtgctctggacagtgtctggcactgagcagacactgggaaaatgtttgctgagtgaaagccacacttgcaggtgctcaggaaggtgaaagcagtgagtgtggcccagcacacaggcctggggcagcctcacaggttccagctcctgattgtgtgctgtggactgtcccttggttcagagccatgggacgcgctcgtgtagccccagtcaggggctcgtcgagggattggtattggggaaaagtcagtgtaggactatagctgggcctttcccatgagcctcaactgtctggatcagtgtgttcttaggcttggcctagatgggttattgttcaggaaagcttcactcacctccctgtgcagagtggtggagtcatatttccctgccccattgatgttggtcttgcctatgtgtttgctcatgtgacagtgaaacattagtagacttcaaacaagaagaagctgtgaacacacttgtgctatctggctcatgccctcctgcatgcacactggcgaactgctgtcatgataagcatatccgaattagtcccagcatgaccatgcatggaacagacctgaaccttgtttgtggtctgaagccaattccagccaactttcagtgggaggcaaagccaatcccttgaccccagcctagatgagctgagcccagtccgcctacagacccaggagcatgagaaccagtacttgtggtgggaagtcattgagttttggcatgcctgttgtgcagcattagcgtagcagtagctgaccaatacagagccccagagcagctccagtggaatgtgtttcatatattgagtttctatataagcatgtttgaaataagaatttgattgttgaaaacagattgaaagcctctacaacagtggttttcaactggaggcaattttgttctccagcgtacatttggcaatgtctggagacacttttggttgtcacaactgggtgggggtcggtgggagggatggtaggatagtggcatctaatggtagaggccagggatgtgctaaacatcagaatgtaccagacaatcccccggagtaaagaattatctggcttaaaatgtcagcagtgctgaggttgagaaaccctgatctaaaatctaagatcatttgaatctttaccaccaaacatctaccctccctccttccctctctgtctccctttcttctttcattcttccctcctctcctcttttcttttttttcccctccctccttctctttctttcctacctcctcccttctaaacaagatagatatatgcccaggccctcagggaatttatcttgagaggaacatctcagacaatataggcataaaccagtgaagtaatgatgacaaatgctatgcaggatgcggtaaggaagaattacaggggggaccacccttggatggggtgatcagggaaggcctctctgagcagctgacagatgtgagggtcagaaggagaaggaggaatcagccttggaagaactaacagaaaaatgttcctggctttgggaacagcaaatgcagagacattgagatgagtgtgaacttggtgtgttcaggaagcagagggagcccctgtctggtgcaagaaaagtgagggccaaccctgccctgcctggcatggggctggagtttgctgagcaattgatacaatccatgtcagctctttggaattcccagaaattcctgtagactccagagtcttgggggctcaagagggttcaaacttaaagctaagaaatcacctcaatgccatgttcaatctattacttacaggcacagggctggaaatggattggcattcaaagtaatggaatggaatgtatttatttgaacatcaaaatccttggtggattaaaatgtgctgggaatgtggagcatgacctcaccgtgacacgtgcacctgctcagctgcattgagatacagggccctgcaaaatggcttgttttctcctaacttccaccctggtcccttccaatacaggctccacaggaaagtcaggacacaaaggaatcattgcactccactctgctctcaggataaaatccatactacttcttcttttttttttttctgagacggagtcttgctctgtcgcccaggctggagtgcactggcacgatctcagctcactgcaacctccgcctcccgggttcaagcaattctcctgcctcagcttcctgagtagctgggattacaggcgcccgccaccacgcccagataatttttgtatttttagtagagttggggtttcaccatgttggtcaggctggtctcaaacccctgacctcgtgttccacctgcctcggcctcccaaagtgttgtgattacaggcatgagccaaaaatccacacttcttgataaggcctacgaagccccccatggtttgatctttgcccagccctcccacctgtctcatcctatcccacttgctctggggacctcagggatgtgcccatacctttcctgcatcacaaggatcttcttatggaacagacttctcatagccctcaacaggaaccagcttggactctgggcttcaggactgtgagaatacaaatttccattgttgaagccacccagtctgtagaattttgctagggcagccctagggcattaatacacacaggatggaagggatgaatttgtcttgaggggttgtggaaggaggtatatgggtgggaagtgggctggggctgtaggtgactgagggtgaggcacttacactaactcctattttggccctgggtgaggctgtgatggaagctgtggttggtgctggcctgggcctttctatgtgtgtgtgtgtgtgtgtgtgtgtgtgtgtgtgcgcgcgcgtgtgtgtgtgtgttttggggatgcagggtgtggcaggcaggaaggagagcttgagccagaggcataatgaggacatggagaagctgagctgtggagccagcaggaccttttctcctggaagagaaaaatgaaacggctggttggctgcgagttgttcagctgagtccttgtccctaattaccacccagaccaagcctctgggcagcatcatcctggcccatctgcagcttctaagatggtcaggatccaagccaggtgccggtgtgtgtgctggtcctcatggccagtgagcagcgaggggactttaattaaagaactaattactctgactctctacgggaacatctgcagccccccagccagtctggagcaggactccctctaatctgggctttcagagcaatgcctgagtgtgtatgtgtgtgtgtgtgtgtgtgtgtgtgcgcgcgcgtgtgcgtgcgtgcgtgtgcatgtccaggatatgtgcgtgtctgtgcatgttggtatgtgtgcatgcacttggacatgtgctttgtgtgccctgtgcatgtatgtgcacatgtattggtgagtgaccatgtatatagcttgcatttctatttgtgcatctctgtgtgtgcaggtgggaacatgtgcacacgtgcgtcatcatggtcatgtgtatgtatgtgggcaagggggtaaatacacatatgtacccaaatggtgtgggtgtgtgcaagttcttatgatttttttcctttcctatgattgaagcttcagcgactctatgggttgcatgtgtatgtgtccctggtcattctgcaactgtgagtgtgtgcagtgtgtgtgaacatggctctataaacagggccccagccgcaggtaacatctgtgtttgcactgggcttttggaagctcttcccaaaggaggggagaattcggagattttagggagcaggtgaaggaaggctggtctgtgaggtggatggtttgcagtgaggggttcagctctgccctgatgccctgcttagtcatgttggaccaaggtgggaggttgttctagacagactgtccagggattgagtgggaggtttggctctgggcaggggtgaatagttccaggtggacagagtaagccttccaagctgaacagtatgcttcccactgtgagctccggtctccttgacaacacagagtcagggctgggccctggggaaagggatgtgcatctccgtgtgcataccacgaggggaactccgggacgctctcctggtgggaactcagattgttttacgaaggggtttggagtgtggggagaagaaaattaaaaaggtctctttcaactgcaaaacaaaattcataagttttaaacttcaggtaagttcagggtctgagcctggtttgctctcagaggtagcatgatctgtttgaatccctgaagcatgaacacaagaggtttggaggaggctcagagtggacataaagagattggaggggctggggcaggcccctgaggaccatgggaaactatgggtgaccccttcatgactaaggagaggagatgggctggtgtgcctggatctgggctggatccttatggagcatgaatgtagggacagagctctctggacagtgggcaggagtggggaagttggcacatggaaaatgctgaccagctgaatcttgtgtccttccttctctctctcccattattttgattatttcacaaggaatctgaagcttcccctccatgccccactggcaaccaagggtgcagtgccagaaaaaaacagatatttccccagaagtcctgggtcaagtatttccttgcaagctcattaaatcaccttttgctttgattgttcaactggtagtgtcgggacctgtgaatggcacacagctcatagctccaagtgctcctggagccacccgtccctgccagctcccttggggctgggaagcaggggacatgccatgggccttgctgtctagaggactgaagggtcattgaccaaaataaccccttaagttgtcctaacctgctagagaaatgcttctggttagacagagcaattgttgaaacactggcctacgttttctactctttaagagataccttccatgaattaacttattaataggagtcataataaagacaataataatattcagggccaccagtagcccaggtggcagctctgagatttagaacaaggcaccatctcaaggcaaataggtgatagcaagttgtcccctttgatggccattgagaatgaggcactccttcctctgaactgaggcagccccactgaggagcctggcgaggaaggggagctcaggctggactccagctgcacttggctcccccttggctaggtgccttggtacaagggtcaacctacacagcagtgcatgacaaccctgggtgatagctagcgttctgcaagtgcttactgtgtgcaggcactatgctaagagtggacatggattatcttattctacccccacaacagctgcacaacctgggaaacatcaaccccgtgttgcagagaagggaggcttcttctctgaggcttcgggaggttctgcatgctgttggaggccacacagtttttaagtgcagcatttgaacctaggcagtctgtctcagagtccaagctcttagccacaaagttaaaggtagggcctggggcaggtaaaaggatgggaggagataagttctcagggagctccaggttggtgggtagacagaagcatgagagcccagtggactctgccagtgccctgtccatgcatcctcccccaattctgcttcctgctgatggaatcttactctctgttcaactgaggctttcccttggattgcatgcagggcagaccataagcgctgaaggttgatgccccagccaatgaagacaggaattatcctttattgggatagctctgaggcatattctaccccgtttcctaggggtttccagtggattgaagccaagttgcctacagggttccccagctcatgaacacaccccatactggctgtcttcatttcctatatcactctcctacacctggtgccttacctggacccacctcctaaatatactgctgttctcagatcctggtctcagggtctgcttctgggggatcctggcctaagacgggggtcctatgaccacccttcctaagcccatagccagccttccctacccagaagacaggagctagaggagtctaaggaggaaaaggagtattatggaaaatctccgtgcctagagcagtgcagtccagctcagaggggttcatttcagcagaggtttccaggggcagggccaacacatctgagaggagtgtgtgcacccgtgtatgtgtgcatgcacagacactatgcatgcacactatggactcaccacacaccacacacagtttccaggcaccaagcaaggttcagccttgcttagcctcatggctctgtggactctagattctcaaacatgaagctaagaggcctccttggggacaaggctgtgcagcagggaagcaaatcaggtgagtggcaggagtgtcctggtgactgcagccacagcaagtggggtgcatgcaatgcagtgcattgggatcaagtacacctgtgttttgttttgttttgcttttttgagatggagtattgctcgtcaccaggctggagtgcagcggtgcgatcttggctcactgcaacctctgactccctggttcaagcgattctcctgcctcagtctcctgagtagctgggactacaggcatgctccatcacacccagctaatttttgtatttttagtagagacggggtttcatcgtgttggccaggatggtcttgatctcctgacctcatgatccgcctgccttgggctcccaaagtgctgggcttataggcgtgagccaatgcacctggctgctacacctgtatttgaatcccagccctgcctcgcagcactatgtgacctcaagaaagttactgctcctctctggccctcccctgcctctgagactctggcccctttggcttctgcgtctgccctgacacatgacctccttgttggcatcccccacaacacccacataccaagaataaggagatgggtccattctacccaaattttggatgctggggagaggatcacatccttcagccatggagcaaacatcagcttccctcttccccttcttcctccggtctcaattcctctcccttgaataggacaagcagttcagctcccatagactcaagtaaccaaccccatcacagagcttagctgaacaaagctgggcagggctgcctcttgagccagcctccttagaagcctgctgggcttagaaagagcaaaactgtcatcttcttattcccacagcggatactgggctttcactaacattttacataaacagggtttagtatctgcaaaagatgggaaaaccacttgagtaaagtaaactgtaaggacgttgccagttccatagagctttgcaaattgctcttcaattttaaacagctcgttaaaatgcaggctcacctggtccccacaggaatctggtaaggtgggtatgatgattatgattgtcccattagctaagtcatcattgaaaagtgagtgatgttcccattttacagctgagatatagggtcacagagatgttatgcacctgtcttattgatgagacagaatgttttttgttataagtaacaaaaacctcaatgaaaatagtgttaaataatgaggacgattcattagcttggatatagaagactctggatgtaaagtggttctagggttggtcaatacagtagctacctactcagtgacttggggtcttgtcttgtcttttctcctttccctttccctttccctttcctttctttcttgatagagtctcaccctatcacccaggctggagtgcaatggcatgatctcggctcactgaaacctcctagcttcaagcgattctcctgcctcagcctcccaagtagctgggactacaggtgcatgctgccacacccagcttttttttttttttttgtaattttttagtagagacagggtttcactgtgttgcccaggctggtcttgaactcctgagctcaggcaatccacctgccttggcttcccaaagtactaggattacagacatgagccacgatgcctggcagatctttccatctttcttcaggacattcccactctgagaagcttcccatttgcaggtaggtttgaagctgtttgtcgttcatgtgttggacattgtgccaaggtagtttcatttacctactttatggaggaggatatggaagcccgaggcactgacctgtggtatccccaggatttgtggcaggacttctcactcgaattccagggctccccttcctcctccatgccaccaggcgctacctccatggaaaaggcaatgccacagttttgagctggttaaggaagatacctcctctgctccctccttcaccatcccccagtgcagagatggagcaccttggttccagctcaagaggggagagggggtagggccacggctgggggacaatttagggctgattcacagtgactatgaactaaggcctgactgagagggtatctgtgaaggacactgatcatctctgtgcttcgctcccaatggtgtctatttataaaatgttttagggagtcattgaatcttcctaaggggcagtagataaagcataaccttggagcagggagatctgctgtgttagtttaggagacgctggctgctgtaacagggaaactctgacatcccagggactcggttcaacaaagcgtatttcttgcttacagaaagtctacttggtggcagggttgagggtgggtgggggttttctgttccacaaagccattcaggcatccaggctgacagagactctatgccttcaacatgtggcttccaaggtccctctggatttcataagctagatgcgacaggacagagcatgaagggctggtgcggggcacccttgggagtggtgcacattattcctcttgattcactggctggaactcagcctcatagctatgtaatctcaaggagagtgggaaattttgtgcctaggaagaagaggaaatggatttggagagccacatcagtctctgccacacttggttttgaatctagaccttgccacacactatttgtgggaccttagcttccttaacatgtctgagcctcagtttcctcattaaagggcaaatggtgataatctcctaggaggtatgatgttgggagggtttcttgagttttttctccaacactcccatgcagtcgtggttcttacctgcagagctccagcctctatgtacaattgtccacatacttgtcaacttccttggtaataactcctctcctggagggcaaactccaccagaataggggccacactgctctcaatcagagctgcagccctaacaactggcctggcgcccagcacttagtaggcattcaataaatacatgtcggggaaatgaatggacggataagttaatatgaacacatatgtgctaagatttactcctttaaaaattcttcctcaataaatattcgcacctctatgttccatcatggtgtggtgagggggagggaggggggaagaagacgaggaggaggaggggcacctttctcccacccctactggagctcaaactataaatagctccagttggaatctgactgcagattcctccagcaaagtcagcatccccaggacctctcatcctggatggggaccgggagtgcttcctcattaatcacagctctttaattaacagctctgagcctggaacaaaaggtgcttaccgggagaacgccagcgggccctgaactctggccgcctgtttttatttggaggacctggcgccttggggagcaggcatggcatggctcagtgctgagcctggcaggggatggggtttggagggcgagcagctggcaggccggctgcctgtctccaccttggacatctccacacagagctgactcgacttcgagcaggttgctggcagctctgtcctcctcaggctgatgctgatgtcattggtctggggtggggctggacagtgaagttgtcacgttccccaggtggctctaatgtgcacagtttgaaaaacactgctccagggatggcaggcttggcagaaggcactgagatgggtccaaaggcctaactgagtgacccagagatggacacttacccaaggcatgcctaatgcccaggcagatcaaaggcccactccctcctcttctccccgttggcggatgcagcaggaatggaacctgcctttccttctcccatcatgcctcctggagatgatcagaggagagccagaccacagaagcaggacttcagccaggggctgggtgggaggcttggaaggcaggaggaagcacacacagcttggcactggaagcagtggccctagggctcctgctgagccccaggtgtaatatcaagttgatgcaaaagtcgttgtggtttttcctattgctttcaatgataaaaaccgcaatctgacaaaaggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaacagttagaatggcaatcattaaaaagtcaggaaacaacaggtgctggagaggatgtggagaaataggaacacttttacactgttggtgggaccgtaaactagttcaaccattgtggaagtcagtgtggcgattcctcagggatctagaactggaaataccatttgacccagccatcccattactgggtatatacccaaaggactatgaatcatgctgctataaagacacatgcacacgtatgtttattgcagcattattcacaatagcaaagacttggaaccaaccctaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccacatattctcactcataggtgggaattgaataacgagatcacatggacacaggaaggggaatatcacactctggggcctgttgtgggttgtggggagggatagcattgggagatatacctaatgctagatgacgagttagtgggtgcagcgcaccagcatggcacatgtatacatatgtaactaacctgcacaatgtgcacatgtaccctaaaacttaaagtatttaaaaaaaaaaagtctaggagaaaaccaatcaaatggtcaacatggatgatggcatataagtgttttaacttttctttaactttttgcattaaaattttttctatattgaataagcaaaaaaaaaaaaaaaaaaaccgcaatgggctgggcgcagtggctcacgcctgtaatctcagcactttgggaggccgagacaggcagatcatgaggtcaggagatcaagaccatcctggctaatacggtgaaaccccatcactactaaaaatacaaaaaattagctggacatggtggcacatgcctgtagtcccagctacttgggaagctgaggcaggagaatcgcttgaatctgggaggcagaggttgcagtgagctgagattgtgccactgcactccagcctgggcgacagagaaagactccatctcaaaaaaaaaaaaaacaacaaaaaaaaacccaaacaacaacaacaacaaaaaaaaaccacataaaaaaccacaaaccacagtgacttttgcaccaaccttataattcttcctaacagatctctaatgttcttttcaaatttgtctcttcacttcttctcttgtactgtgaccactgttgaagggctccctacagcagacctggctcattacagagttctgttagcatgccctctgaaaggcagtgtcttcatctataacatggggacattatgcttgacagattcccagtgtttgcatgtggtaggtattcagaaaattcttgtgtaaactctaaagttcaaatcaaagatggcaaagagttttcattccgtatgccagccttcatgtgaatggccgcggtcacctggaaaggaatttgaggccaaactggggctcagtaaaaaggatgcgggagttgattagtgatgtctctcaggggtgcaggagcaggaagtgatggccagaattgcacgactttgccatccctggtcttggcgtaaactttatgaaggtaaggattgagtctttcaaaagttcacttttgtgtcctttgcgtttagtaaagaatctggtgtacatgaagtgctcaaatgtttgtggaaagaagaaatctgtccattgttttttctaattattattttcttgactgttcctagtccacccttcactgggtcttttttggagtttggattcctgtctcctttcctagagtgatggtgtcaaagtccctaagctgtttttggaagggggctagtgtgattgagttgttggttatgcagttaggcaggcctgtgcccacgtcctgcaggcaccactgcatcctggctgtgtggtgttgggcaaggcatttctatttgctgagcctcatttgttttttatatcatatgggaataatattggattggtgcaaaagtaattgcggtaattttgcaaatggcaaaacccacaattacttttgcaccaaccttaatacgaacttcctcacatcttatcctgatgattacatgattaaatgaatctaaaatgcccagaaaatgcaagtgctgagagttggtttgcttctgaatttcaaagtccaaagtttatttcatttttttccccctccctttccgtaggcaactgcagtggggttaaagcatgaatttttatgttccctttctctgggcctagttttgtcactctgaagtcctcatttttatattctcaaatccctaattcttcccctccctattctctgccctgccacccacctgccaattaatcaattgtttcagttttctggctacatcttagtctagccatacaagctctctccttaggcttttattttccaaaaccaaggatggcatccagtatgatggcccccgctgctgcctctgcccagggtgctgactttctccaaactctcaagcaggggttaagtattaagaggtcatccctgggagtaacctgaatatttgggacttttttttttttttccccaaaatggtattttccccagtctacttaagagcatattaagtgtacatattcccagatctcatctaagacatagggaatcggaccctgggggagtggagactgggtacctgtgagcttcaagcacccaagtgaccctgtttcactctgagttttgacagtaactagagaatgttcctaagagagaacctcatttaaacagtttcccaggatgccctggcatttctctttgcatgctccagcccatttagctctttttacagtggctttcaatatggacttcacactagatcccagatcaattatgccaggagttttgggggtggagccttctaaaagtcctccaggtgatttgaatggggatccagggctgagagccatgaaattcctgagattccagctcctgaggaggaaggcaatccttggacttcttattgcaagaggagtagaattctctttgctctctgctcttacgtcctcatgattggggcagatcctagaagcctggttgcctcgtgtatgcagtagacacagttactatgtattaaaaccacttgttactcatggacttggccctcaattcttcctctcacctctgtaaaattggtctagagcagtgataattttgcccatctttttctgtcatgcacattttagcacccttatttctctgttctcccagttgatgtggcaggcaggagtgcagtagtgcaccaagattcaggctggacaagagaggaatggagtgaccctcctaggacaggctcctagcacaccgctggtctcccccttccccaggaaattaatccttgttctggcattactaccaccagagccctctagactctatgttagtgtcttggagggggagcttactatctctttgggcagcttactccatatttgagaagttttggggaccaaattcatcactacccctcttggttctcagtaacaacagaacaattcttcacccagctaattctcagacagatctcagcttaaatgctgcattttcaggagcctccctgaccactccattttatttggtaccccccactttctgctacttactacactaagcttgttatctttattacaaataccacaatcgatgttatgtttgtttgcctgtttatcacctgtctttcccaccagactgtaagctttactaagagcagggaccaagcctgctttattcacatgattcataagggtcctagcaagaaatagatgtcacacttgaattctgtagtttgagtttaataaagggactttttataagggtataggctgggcatggtagctcacatctataatcccagcactttgggaggtcaaaggaggagtattacttgagcccaggagttcaagaccagcctgggtaacaaagcaagaccccatctctacaaaaaataaaaaaaataatcagccaggtgtggtgtcttacgcctctggtcacagctacttgggaggctaaggtgggaggatcacttaagcctgggaggtcgaggctgcagtgagccatgatggcaccactgcactccagcatgggtgacagagagaaaccctgtctcaaaacaaacaataaaactccccccaaacccacaagggtgtaggcaggcttagggtaatccacaagggacagtatattacccaggactagccacaccagaaagctgtgactaacccaataactgagggtttttgcattcccaaaggcgtggtactggagccctggctggagcctttggttgaggccaccagcagcaacttgacaaataccttgacctcgctctcctcttgccttctgatcttctattgtctgagcctggtcggaagtgagggagtaagggagtccattgatatgttttatcaggtgaacattttggggtacagagcgggatggagagggcacccatggatctgaaggggccgatgaaagatactccacatttgctgtcgtatgcacagatcctggcactgtatctggcacataataggtgcttattaaatgtttgttgaacaagtgaattcttattctatttgaagagagtagtcatgccatctggatctccaggttcagctctctgttcattctattaaccttcagataatgcatttttgtgacccctttccaccctggttgcctttttctgagtgcacttctgttagttatgtccctgtaaagtgtagtctaggtgtggtctcattggcacagagcagcaggaccctcccgctgtaatctctcttcataccgcctgagatcctgaaatcccagtatatttttgggaggacatgccatgatgtcttcttgctgtcaagtgaaacccctgcatacttgcatgagctgctgaacatgttgattgaattccaggatatagatctgctttgaacgttgtctgactagtgattataggatttgacctaaattaagattaacagtggcaaacaccacacatgcatacttccatggcagacattactaatctatcaaagccatgattttctgctacacctctgaatccttctcaacacatgctttaggcagtcagtaccaatctgttggaagtggcatatgaaataaaacctattgaccattcttgctgtaggctctctttggatttgagaaatgaaggatgggaatagaaactcaaatatcttaatgaggaaaaaactgtttctattgtctgctcagccactgagcacctaatagggtctatgtgaggcttaagcaagcatgtgagtgaagtacagagctcagcgccaggctcatggtaagtcctcacattgctgtggtttgaaaaggaaactgtatatccaacaagtagaacttctcaaactctttagcaggaaaggcaagccacactgtggggtcttgctgtacagaattgaaggagctccaggtgagagtaagcctataatttgtagggcagctggaaagtcaaggtgctggagccagaaggcaagatgaaactgagacagaatccttaggtgggacctggagtgagttgtgcagccggagacccgccatgctgatgaatgcttcaggcaccagcttactccctgagttttggcctgtcctagacatccaacatgcttacacaagctgacagagaagcttctgcctccatttctcttcctggagcccagcttatttgtcaggggtccagactttggacttttgcttggtagggtggattttattactaaaccttcagttgctggtctgtgctctatcctccctcacctggcacatttctagttatcattaggccagcactagttatcactaggctggctctcataagaaggcgtatcttgaatgacatgtacattaccaatagatatgatgtgagccacaaatgtgagtcacttaatgtacttcagaatgttctagtagtcatatttaaaaaagcaaagagaaacagttgaaattaatttagataatatattttatttaatccaaatgttcaaaatctaatcatttcaacatatgatcagtataaaatgactaatgagatattttgcattcttttttttgtagcaagacattgaaattaggagtacatttttcacctgcagctcatttcaatttgcatgaaccacacttccagtgctcaatagccacatgtggctggtggccactgtgttacacagcacaggtttatgtcctaggcaaatcctacattctcagggatgtccccaagcctgacctatttgctccttccttgggctctccttatcaaaacagttatcatactttactgttattgaaagtttactatttctcctcttctctggagaatacattttatcttattttttgaggcaggatttcactcctgtcacataggctggagtgcagtggcatgatcttggttcactgcaacctccgcctcccaagctcaagtgattctcctgcctcagcctcccaagttgctggggttacaggtgcacaccattgcacccggctaatttttgtattttttttgtaaagacaggattttgccatgttgcccaggctggtcttgaactcctgggctcaagcaatctgcctgcctttgcctcccaaagttctgagattataggcgtgaaccattgtgcccagccaataatacattttataagggtagtgagcaaatgtgcttgtttatgcatctctctacctggcttgcctggcatatacaggagttctataaatccatgttgaataagtaaattaacagggccctctattctccagggaccccaccaccttttcttccttgcttccacccctgtccctgactcagtttctcagatcctggcacaccttacggcctccccatcccctctgcttgtctcatcctgaggcacctgacagccgggattattagtgggcagatcaggcaggggcctaatggacttgggcagcgctagtggggagccagcacagtacagggggcaggcagaggggcctggaatgacgaatggccctgcctgctggcccggggaggcgccacgcacatacttcccaccgatcggtgccagcaagtgatccagggacactgctaaatgccggctttaaatctcgcttaaagggccatcaagagcagcttttggccgtgagcatctttgccattattctttactaggcccttttaacgtaactgggaacagggcaatattttgttcatctgtagctattggaaagaggctcagcggagtttaatggctgagagctgggcagcaggcttatcctgggagggatctggggccagctgcggccagctctggggccttttggggtagggtgggatctggggtggttctttggtggctctgaggggctgggccctgtagcctgtgaggatgaaggctgacttcacctcctccccagagctggcctccatgctccttaggtggggtgcctggctggatacttccaggggcccctgctgcctcttggattcctgagcaaccaggagctgagagcaacagactcagcagtggcatgttgggggcaggcagctttgcattcccaaatcacatgctctttaagtctcaacagaaacagctttaaaaaaattccgacaactccttatagtccctggtccactccttccaggcacccttcagccctggcctctcagcctcaaattatctatgcaatgtgaaagcccccattacactgcttccaaagaagcagaggctcacagtcctttcttgggggagacacccttgtccatcaggtgtttgaactagtggactagcagccaaaggtctacatgatcacccaccagccagtgactcttacaaatatgaggcttcttggcaacccttaggcagggctgacatgttgtccaactcacgggagggcaccattcatatcaaggtctatgtgaatggcatcgcctgaatttgtgcagtgcacagcttgggcaaccacacgcagtagctctgtcttcagcctctagtgcgtctctactttggcatggtgttgatgtgggggtgaggggcctggctgtgtggttctcagaaagggtgatgatgggttagcctcccttgacagaggccactgctgtccttggtgtaggtctgagcctcttcctccacttcagaattctagaccagggattggcagactgtgcagttctattggtctgcagccatgccatacatatgtagttcatgtattgtctgtgactgctctcaaacagtagacaagtgaaagctacagtcgatcatagagccctcaaagcccagattatttactctctggccttttaagaaaaagtttgtcaacccatgttctagacagtggtgagaggaaaggagaaggcttctaaatgcttccttactggacatctttggagggcctgggggggggggggcttttattgattgctttaattaagcaggcctggatatatatacctcttttcttgctgtcactgacttagtggaagtaggagtgtcccaatatctttgttgtgtactatagctgacatccaatccaaggctgtgtgacctcagggccaacagagccgtgtgtgtgtgtgtgtgtgtgaccaagagagccgtcattcaagaactcattctgcaaatgtttattctacctgccgaatgccgggaaaccagatgctgtgtgtacagagacaagtaagacataggtccacaggtcctgacctggaggaggttatgggctagttaggaggaatgtgtgtacacagataactggaatatggtgtgaagagtattataaaacagaggtcctaagatgaactcttccatgaggctggttggggggatggggacaaatgagtcgggtcttgaagtagaagtagaagttttccaagtatatgaaagaggatgagggtatttcaaacacatggtcttagttctgatgtagtttcagcacctctgggactgagtgtgtaaatctggaaaacatttagaaaagttactgcgttgagtctaatgtctcttgtcctttatagtctcacagatattgcaaccctgtccttgtatacaaagacatttatcttcatttctctgtccaggcacagtctctaagtagataattacactggcaggcttgtacaaagatggacttggacacactcatgtcagccttgttcagttcattcccacccatgcctgccacacagctttgtacacacacctgagcctgcatgtgaatacacctgtggacactgagcagctggaatgtaaacatgcacacatatccctgtacacttgggtgttgtccttgatcttctgcctccagcgtatgtgatcacctgaacttcatcctctaccaccagtgataacctggctatggaactcaggcatgaagaatgttttgactaactcaaatgtgcctctccctagtttcttctttactcttatgccattccctctttctaacccacactccacttttggtgaggatatatggtttatatcctcaacaaaatatacatggtgctgtgacctggggacaaataactgggtgctctatttaggctgaagccaggtaactgaagtctcagagagctcactgttgtcaaggtgagaatctcgaaggctgggctactgacttgtcacatagccttgcttggttctaacagctccttcctggaattcaggtcatcaggaaactcgcaatccatcgagggaaggagtagatgaatatgaggaagctgagagattttagggctgtctcactcatccaggaatctgcatataatattcttctctgttttggcacatggaagccttagtgttttgctggtggtcccacactgaatagagtggatatgtccatagagtctacttatctcatgtacttccctactgtagattttattatacgcaaatgttcttggtattttccactatcatataataaacactatatagaaaattgaagtaataaactgggcatggtaggaagaatggatgaaaaacttgtacatggtgaaggaacagtatccctaatatataaaaagtgcctataaattaataagaaaaatgcaaatagaaaaatttgcaaagggtaaggacaggtaatttacaaaataaatttgagtgtcctgcaaacataaaaacagttgaacttcacaacaaataaaaatgcaaataaaaatataatttgttaccgagaggactggcaatgattaaaaatgaaaaataactgactaatttgaggttgtacagtagtaaaatctcatgcaccatgatggtgggggcaatataagtttgttcatcttttctgcagggacaatgtgagaaagtttatctaaattttaaatgtacacaccatttaaactggtgcttctacctctaaccatctatcctaggataataattggacaaatgaacaaaggtgtacaaatgaacaaaggtgtaggtatagtagccccttatttgtgggggatacattccaaatcccccactaggtgcctctcactgtgcatactactgaaccctatacaaatgtaccgtgttttttcctataccatatatacacacctatgataaagtttaatttacaaattaagcagagtaagagattaacaacaacagtaataaaatagaaccattataacaatatacagtaataaaagttatttaaatgtagtctctctgtctctcaaaatatcttattatactgtactcacccttcttgtgaagatctgagatggtaaaatgcctacataatgagacaaagtgagttttcgaatgacataggtattgtgatgtggcattaagctactatcaaccttgatattttccactatgacaatacatcagaaggaggataacttgcttttgagtggtcctggatcattgagccatgatgatttttcaaactgaccgtgggtaactgagacgatgaaaagcaaaactgtggataagaaggggactactgtgcaaggctattcatcacagcattgtggataggaaaaaagacggaacaacttaaatatccattttagctgtccgtatatgactagtaaataaattctggtaaaatggttaaaaagaatgatggagatatatgcttaatggcacagaagagcatcttgatatgtgagtgaaaaaacgagacaggtggtataatagcatgatctatatgcaaagtaatatatactcctatggctgttgtcctggagtgatgggacattgaagaatctttgcgtctttctggaggtgtacatttttctacaacaagcatataccatcttagtcaactttaaaaaaaattgcagtgccacaaccctgtcttgtttgatgttgctgatttgcctataatgaaatctataatgaggaagtacatgaattaaatagaatctatggatatatccagtctgtccagtgtgggaccaccagatcaatgcccaaggtttccatgtacccagatggaggaggagatcattttcagatccttgggtgggtgagacagccatcctcgtttttaagatagaaactttcattcatctcagtgaagagagtgtattcaggtctttgaacccaccgggctcaaaggtaatgatctataaccagataatccacagtaaggcctcttcaccatctgggtgagtcaatcctggctggaaggtcaatccttaggcagaccgtgatgttgtcttggacatcattgtttagagtgagaccaaaagggaggtgagacctttagagaccaaaagggagtttacctgtgatgcagggagggttggaatgaggaacctcagggcttgaaggctctgggttgcaggggtaggagatgactgatgggctggacttgttaaccccttgatgtcctacttaatctcttccctagctagtgcaatgatattgattagaatgatgacattcttttttttttttccccccttcttgtaagagacagagtctcgcttttctgcccaggctgaagtgcattgttgtgatcatagttcactgcagccttgaactcctgggctcaagcaatcctcctgccttagcctctcaaagtgctgggattacaggagtacaccatgatgcctggctgaaattctttagatatggtaaccacaggccccttatatttctacaacggccccattttcaaacattatatcctattatgaggcacatgtcctgatttttgctttggaaaatatggtacctgcacctttaaatgtttaatctcccccagccatgatgagaagaagagaggggaaggaagttggtatttaggggtgaatgcgattgagtggttatgtgaaggggcgggagggcggagtgaatgctgggggaccccgagatattttctttcttgtctgttttttccaccccatttctttttcctccatgtcaacaccaaacaagacaggactaaaattaatggggaaagcagcaattagcaaattaggttagcggcgtgttgccgagaggcccggctgccaggtgcggggtctctggcaggatatttattagggcctgtcagagaagtgacactttgataaatggagttgagtaatcagccccttacgacagcaagcattgtgaggcctcagcatgcacgactgccggagccaacctttgttatgatttttaaaaatttaacactcataaaagtaatacaacagcagcatccacggccacagagcatggcctcgaaccccaatcctgatgtgcaagggaaactgtggatcttgagttttccttttggaatgggcaactgggaaaagaaaccaatgtggaaaagtctgtctgagttttggaaatgccctagaattaaataataaaaaataaaaaacaggagtgggttttaaagaacaagaagtgggggagttctgttttcacttggctagtctgcaaaggtgaccgtttgctgaggcgccagagtggctggagttgaacagggggaacggacactgggaacccaaggagggtggctccgtacactgatggagaggcccctgggaccaatgcctgtaaggatggcttgcccaagattcttgctgcagggattcctttccttggcaaacacatgcaatttagctttcctctgcaatgaccagtttcctggagggaggattcaataaccaggcagagagcagagcacactgccctagtgacagggtttgaaggaggaggaccaggttcctggccagagatgggtcactgtgactttcagaagctctccatacctggcaaatctcactggagtataggctcaatgtgaacaggctggctggagagccactgcctctgtttcctggccttcagcctgctgcttcaatgcctggcgtcgcctcacttccaccaggtcatagtcttcctcagctccccactgagagcacagtttcccttgcctgagtggtatagcagtactagaaacttctcatttgactgatctgctagctcttatggtgtctcagttgctggaatcctgctctgatcctgttttgcttggctggaccctgactcttcgccctctcctaacactccctattgcactggactctgtcactctgtccccaggtctggtatcctgatcagggttggatgcatctggatattgatgtaggccgagtggaactgaatttgctatacctctgtggacattggcactggactgctgacttctcaccttggggccaggtccacagccaggtggccagccccagcctgctcctcttccccatctagctcctgctgaggttcaaggagctgcaggcctgacccatgccagtgatggttctgggtgagtgcctttgataacctccagcaggtgtgtccccaaaggctgactcagtctcacgttccctaacacatggccctgagtagaatgacagtatctgtggtaggagggagatgggagtttgggttgtgactggttgttccaggtatcagccactagtgtctcctgcctggccccctataggccctgagtctctgaaccttccttcgggctgggaccagaggctgataatagagtgagcctcttcccagtcttctttggggcaggctcaccgcagtccatctctgtggatggacactggggcatggtgaggggtattggactctcatgtcaaggagggtggggaaacctggggttcacatcctcacctcaggagtccgaatttgggatgaagggcaatgtgagctatgctccctagcaccttgctaatgttctgccggacatggcttttgccattggtttgagttgggtcaagccagggaagatccttgagctgggcacagagctccaggtgtgctctgtgcagcacagaggactatagaagggtcccctctcatgacccatgtgcctttttcaggaaaaacaatcctattattttacaagagggtccacaggatttcaaattcttttcccccgagcttatgcaatatatgatttgaaccgaacttcaatgtgtgatgaaagaatcacccctgttgaatttcctttgttggttttgtcccagccatccagtttgtggagatcattttgattctgccaaatcagttatttcttaggctttggaagagaagagctcattttctaagtctgtgaagttataagagaacatggcaagaaccaaacctgtggccccctgctgagatgtctgccattctttttttccttttttttttttttttccagacagggtctcactgtgttgcccaggctggagtgcagaggcatgatcatggctcactgaagcctcaacctccagggctcaaactgtcttcccacctcagcttctcaagtagcttagcccttaggtgcatgccatcacacccagctattttttttttttaaagaaataaagtcttgctatgttgcccaggttggtcttgaagtcctgacctcaagtgatccttctgcctcagcttcccaaagtgttgggattacaggtgtgagccaccatgcctagccatgtcttctcttctcttttttttgagacagggtctggctctgttgcccaggctggagtgcagtggcatgatgtgggctcatggcaacctctgcctcctgggctcaagtgatcctctcacctcagccttctgagtagctgtaactacaggttcatggcatcttgcccagctaattttttttttttttgtagagatgggcttttgctgtgttgcccaggctgatctcgaacttctgactcaagtggtctttccgtcttggtcttccaaaatgctgtgatttcaggcgaagcacctgctccttcctctacctgggaagccccagccccaagaatctgcatggtctgcttcccaaccttcttcagtctcagtcaagatgcccccttctcagctcttccctgaccatcctacttaatgctaatttccccactgctcattctgtccccttaccttgccttggtttttcttcatagcaatcattgccatggaacatactatacatgttactaagctgtgtgctgtgtctggcacctcatgcagctacctgaggacatgggttctgctgattttattcatgctatatccacagtgcaagcacagagcctgaaattggtgctatctcaataaataaatatttgttaaatgaatacttgtctaaaatacagatattatcagtcccaagcatgggcactgcatcaaaaaggaaattagagtaatttcacctgacattctctggagatggacatcagatcatggtaattgcttcattctttttaaattacttgccaactgaccagtttatgagaaggtctagagtcaaaaaagggattgaatctgactgcttcctgttttggaaaatcaatacattatttttcttctggcttctccagcattctccttggtttcctaaagattcttcatgtgactttgagatggtatcagtgagattctgctgttccctcccaccttgtctgcaatattgtttcaaagcagagtttttgcaccatcatcaacctttcctgtgtgcctgccaggtgcagagcactgtcctaggccttgaggacacaaagccacagagaacactttctttgcttcagagctttctcaggagtcatggtggggggaaagctgtatccaaagtgacagtggcccagtgaagccacatgttgagaccatgtgattaggtggacagtgaacatgatgggtcgaggctaggtcagcatgggcatggggatcttgcagaccctgctgtgaggttttctttctgtggattatgcactcaacaaatatgtattgagcttctgccatgtgtcaggcactgtgctgaacactggggacacagtaatgatttggacagatgcacatcctatcctcatggagccacatagtctagtaggggtgataaacaagtaaacaaataaaagaatattttgcttgttacaggtactgggaaggaaataaacatagtgatgagattcaaggtgaggtgaataattatttagatagggggtcagagaagtcctctccaaggacttccaaggagctagccagggagaacaaagaaaggtcattccaagtacctacagaagccccaaggtggcaagggcttgatgtgttatggaatctgagaggagaccagtgtgctggaatagactgtttgggaaagggatagaatggtgtgaggtaagctggatggggaaggcagggatcggaccatacaccgcaccttgtaggtgatgagagggcaacaggatttctgttaggagcaatggaaagtattttgggggaatagcatggtttcacttccattttacagagattgctatggctacaacatggagaatagattgaagggaagtaagaggaaaagcaggacgactgatgaggaggctgctgcagttgttctggaagagatggtggtggccagggcttggtgagggtggatgagatggagagaggtggctggatctcaggcgtgctcaggagttcaggtcgacaggagttgttaatgaattgggtgggattagggagaaagcaggaatgactcctagttttcagtttgagcatgcggatggattgtggtgccatttacaggaagaacatgcttatccagattcacctggtagtgagtgatgagttatcaaccttctaaatcaccacaggtatgaccactttccccccatcaccagagtcctaacaagaaggctgtatgccccgtgctgggtgagctcctgtcattcccaggctttgcacaggtggtgggctttcagaaagcaaacatccctgctttccagaagcttagtgtaagattttctatatataagactgtgtcatctgcaaacaggtataattttacttcttcctttcagaaaaagcttttgactaaattcaagtttggatgcctttatttttcttgcctcattgctctggctaggacttctgatgctatgttgaatagaagtggtgagagtgggtatccttgtctttttcctgatcttagaggaagagtttttagtttttcaacattgtgcaatgttagctgtgggtttgtcttatagggcctttattatgttggcgcaaattccttttatacctactttgttgaaaattttaagggtatgaattttgaatttagtcaaaagctttttctgcctttattgaggtgatcatgtcatattagttctttattaatgtggtatatcacattaattgattttcttatattgaaccatccctgggataaatcccatttggttatggtgtatgaacttaatgtattgttgcatttggtttccttgtgttttgttgagaatttttgcatctacattcatcagggatattggcctataattttctttttggtagtgttctcatctggttttggtatcagggtaatgatggccttgtaaaatgagtttggaagtgttccttcctcttcagtttttttgaagagtttgagaaggattcgtgttagttctcctttaaatatttggttgaattaaccagtgaagccatctggtcctgggttttctctattgggagattttttgattactgattcaatgtcctcatttgttattggtctcttaggttttctattttttaatgattcaggcttggtaggttatatgtttctagaaatttatgaattctaggttattccatttattagcatgtaattgttcatagtagtcttttacagtcctttttatgtctgtggcatcagttttaatggctcctcttttacttctgattttgagtcttttctcttttttcttagtgtagataaaggtttttcaatttttatcttttcaagaactgaactcttagttttgttgactttattgttttttgattctctatttaaaaaaattttgctctaacaataaaggccatatacaactgatgtggtttgtctgtgtccccacccaaatctcatcttgaattgtagttaacataattcctacatattgtgggagggacccagtgggaggtaattgaatcactggggtggttacccccatgctgctattctcatgatagtgagtgagttcttatgacatctgatgattttataaggggcttcttcctctttgctgggcacgtctctttcttgccatcatgtgaagaaggatgtgtttgtttccctttctgccatgattgtaagtttcctgaggcctccccagccatgtggagctgtgagtcagttaaatctctctcctttatgcattacccagtctcagcagttctttgtagcagcatgagaacagactaatacaacaacaaacccacagttaacatcacataatgctgaaaaactgaaagctttttctctaagattagaacaagacaaagatacccacctttactacttctgttcaagacagtgctggaaatcttagctagagcaattaggcaagaaataaaaaataaaaggcattcaaatcacaaagggagaaataaaattatctctgtttatagatgacatgatcttatatgtagaaaaccctaaaaattccacaaaaaacctgttagaagtaataaacaaattcaataaagttttagggtgaaaaatcaacataaaaaatcaattacatttctgtactctcacaaggaactatctgaaaaggaaattaagaaaataatcccatttacaatagtatcagcaagaaaaaaatactaagtaatagacttaaccaaggaggtaaaagacttgtacactgataactataaaacatcagtgaaagaaataaaacaagacacaaataaatgaaaagacatcccatattcatacattgaaagacttattaaaaatgttcatactgcccaaggtggtctgtggattcaatgctatcctcatcaaaatcccaagggcattccttttttttttttcttgtttttttgttttttttgtttttctttttaaacagcagtagaaaaaacaactctgcctctttggtgcaggtttctgcaatgtacagttgatgagtccttcctctgtagaaaggcagtgtggtgtagcaggcagaacacaatgattttggagtcagcaagatcatcacttttatgccttggccacactcaacagtagtgttgggcgaggtttatcacctctctgaccctcagtctcatttgggttaatgccaaatgagtcaataaattatataggatagtttccaacatataacaggctctcaataaatataggttgtaaattactacagaaactcggaagctacatctcaaagccatacacattagggagggctttatctttaccccagcaaatcttgggcatgcacgtcttccagaccagggatctacacatgggtgagcaaggcagctttaaccactctgcagctaaagggaccttttggagcactgttttggggttgcatgtggcagggaggacattaacattggacatggttcagtgagaacttgggctggtcaaatattatgatcattattatggtacaagggctacatggaatggccagatgattttgtccttggaaaccatgggacttgggcagagaggatgcttctttcaggctccagccatgacagttgtcccaaatcataacagaaggaaggatttaggccccatgaattggattaaacttttacaatatcctataacctttgctatcgtcgccacgactgatgtcaccataacaacaacgataaccaccccctccccaatataagtttcataatgatttgttcattgcaaaatcaccaatgcctacaggagttcctggcatagttgtaaatattactgtttataataaccattaccactgttaaagttagtagcagctaacatttaaaaaatgcatgtgttcatcatctcatttaattttcacaacaatcttatgatttaggctggggttcacaatctacaacctgtagaccaaatccagcctgtggcttattttgtaaggtctgcaagctaacaatgctttttctcattttaaaacagttgtaaacaaaatgaagaagattatgaaacagagcatctggcccacaaagcctagaatatgtattatctggctgtttgccaatccctgatatggagtatttgccagagtaggctagtgatatagtttgaatatgtgtccccaccaaatctaatgttgaatggtaatccccaacattggagatggggcctggtgagagatgtttggatcatgggtatggatccctcatgaatagtttgggtcatccctttcgtgataaatgagctcttgctctgagctcatacgagatctggtcgtttaaaagtgtgtgatacctacacccttgcacctctttctcttgctttggcttttgccatgtgatgtggctgctgctcctttgctttctgccatgattataagcttcctcatgtctccccagaagctaacaccatggttcctgtaaagcctgtagaactgtgagccaattaaacctcttttctttataaattgtccagtctcaggtatttctttatagcaatgccaaaacagccaaacacatgtagtgtatgctgccataacaaacaatgaactgaatggcttagcctaacaaaggtttatctcttgctgactcaatgtcagctgtgggtctgtgcagccctccagcgcagtcaccttccagatgatcagccatccaggctatttttattctgcagctctgatatcttagcatgagacctcttggttattgtggcaggggaagagagaggttggagagccttctgggaactttttagtgtgtcattcagatgtgacagctgttacttgcacacgtgtttcattaaccagaacttgtcacatggcccagcctaactaactatgaggggttaagaaatgtgaaggagcacctggaatgagatgaggaagctgagtttctgagaggtaaatcctttgctcaagcttacacaacaaggaaaaggcagaacaaagacacgtatcaggcaagtacaatttccaaagtccgtgatcttatctattacattctccttttcttatgagctccttgttccagcaacaaaccgcattaaacatttcgttactttggagtggctcagacagaatgttcctatggttgctgacacatctcccagagaagtcttcccagctctacacccccactcccagcctctgtcctcctggctctggccccaaaggggctggaaggtgccacagccagagtaactcatgactcctttggctcctcacagtgatgaatgacagccatccatcgtgggccttgctgatggcccagctcatccatcatggcctggtgttctcaggtgatgtatgagtgcctgaagaatggattgcttaacggccgatttgcttggaaaagaaactgagccaaagagtggattcaatctaattacctgctcactctggccaggcctgagaggcactttggcagcccctcataggtccccgcagaaatatgacttgcagttcttgagctacgaggtcattcctaactcattgctgatggacagggcattatttaaaaaaaaagaaatgtggggaggagctgttggcaggtttgctgcttgatggaaagctaggcaggccaggtgaatcttctggaggtgaatcaagggcaaaccaaacaatatttggggtgataattgagatgaatcagaggtgttgggtcaatggacaagtcagtagtcaagactgtgagctctaaagctcaaaaggctacaagactgtagccttggttttgtgtcctattcctgtcacttactctctgtataaccttgagtaagtctctgaacctcagcttcattttctataaaataaaaataattgttgtgagaatttaatggaataatagatatgaagtgctgagcatagcaagtcagggcctagtaagtgatggtgagaattattataatgaaaaataatattaaagattgttcttcttgatatctatcacttaggggttgcagtattgccagagagacagtattggacaacgataactgcaaattgttattctcccactgagagatggagtggctggcctcatgtttacttcaaccaatggaatatgttggccactggcctctgctcttctctctccctgttcttattccaagctgcccttgccatatctgcttctgatccccttggtttggtgacatgctaggattctgttttctggccttcagtatctttctattagtgtctcagctctatatcctcctttaactatggtgcccctgaagccttggtgagagtcactgtctccactagcctgagccctgcaaagcttccattggtgctgtgccagttctgcgccttgctggcctttaagagaactggattcttctacttgcttttttttttttttttttgaacttgctctggggaaagccaaataatatataagatgttcaattaccctgagactgccatgctatgaggaagaacaagctaaccacctggagagaccatgtagagagggatgcttggccagttctcatcttttctagccattgcaactgaggtgccaaacgtgagtgaagaggtcgtcttggatgtccagctgagttgacctttcagatgaccatagtcccagccaccatgtaactgcaactgcatgagaaaccccaagtgagaactgcccagctgagcccagtcaatccatagaaaaatgagagggagtgataaattgctatgctgaactactaagttttgaggtgtttggttatacagaaatgaataactggaacaggaaccaatccggataacgagtttattcaaactaataattattgaatattaaatgccaggaattatgctgggaaaataagctggtggatattggtcttgcagcctaaaagctctttcaaaccttagagttccaagatatggctgcagagaatgcctttcataaattgatgtgctttttcagcctcagggaggaatataccacttattttggattatgaaacttaaaaatgccttcttttgtaccgactttcattcccatacttaattaacccattcttattttatttttacattgaatatatcacagaacactaattttgtaaaacagtatttctcaaaccatctgtgttaagatcagtgcacatgtgtgtatgttttaaattttcaacctgttgcatgcagactgatacttttgtaaaatacaacaaaaatgagttactgaaaaaatgaaaaaaatacacaaaatacaggcctactttttattattagattcaacagacatatagttactctgtcaaattgttattatggttcctaaacagctgctctcaatttcgtttcttgttacacgtcaggagccagtttgtgaacagcaagtatctgtggatcacacaccaggaatagtgctgctgtagaacacacttcacatacctcaggaaatgctactgtagattaaagaaaatgcagaattggggaagggcttttttttttttttttttttttttttgagtatgatgggacttgagtctgttttgtattttgagaggaaggagccaatgttgtgggagaggctgaagatcctggaagatgggcggactgatggaataatgcctcggagactgcagtagataaacagagagcaaggcctctcccaggaggtcaccaaaactgcccacctacctcctccctaacccactggcttctgctttcctctctccctgttcttattccaagctgcccttaccatatctgcttctgatgcccttggtttggtgacatgctaggattctgttttctggctttcagtctctattagcttcttagctgtatatcctcctttgactatgatgcccattaagccttcgtgacagtcgctgtctccatcagcctgagatctgcaaagcttccattagctgcacaggcaccaaaggaaggaacctgtgggcacgttcagtgggtgaacctggaattagcctcatggccacataagccctgtatggacataccttttctttctgtctgtccagctttgattattttaggaactaccaagtcctttgtctataaacatcttggtcaggaaactgaactttccaaatacggcttttaggaagcttatacccctgccacccatgggtgggcatataaccccgccaggccaatcagagcctttgctgggacttttgcttgacgtattatgaaaaatgacattgactcatttggaatatagccttaaggacagacaggctggcttggtcacccctaagagggggtaacctacctaaggacacaatcaagaagagcaaagtcaagagactgagagggcttgattaagttctgacagcagcatcacttggattctgctgtatctcagacttagacttcccagttatatgagccagtatgtttcttttttaattttttgcttaagctattttgaattgggtttctgtcactcacaaccacaagagcttggatgaatacattcatagttcaggggtggtaaacccatgatacatgtcccactagttcctaccttctgtgcccaagataggcatgttaataaatcacaacactcttactaaccctagacttgacttcagaatttttctcaacatagaactacaggcagcctctcccaaccaactagagcatgcacgtgagatgaaagttacttgttatcctcaggggaatattggatgatgcaggtttctgtcatgttttcctgattctgtggctggtgacctgccatctgcttcaccttatctgttcttttcagtaattctttccccaagaatgagaacccgggactttcatttccacctgcttcttgaatcctgctccaaatatactcaagtcttgcagttatgactttgctgcctatgtgatggaccgaaagtcacctctccttatatgctcccatcctgggcttcattccccagtggttacagatgcagccttgctgtgctcctctacactgagaaagtccccctgccagtgagttaatcccatcctgggattaactcatgtcagtgaattaatcccatcctgggattaactcatgtcagtgaatttttaacaatggcccacttgcatcacacagcttggattgtcctataaggtgtcccattggtgactgatgtagtcttctttcaatctattctctgcatttcagcaggagtggtctttcaaaatgcaaatgcaaaccatattattctctgtctataactctgcaaaggcctcctattgcatttatgttctacaaatgttgacttcttgctatggctttcaatgccctgcacagtctgctgcctgtcagcccacccagtctcatgctgaatgaccacctcctcaccgtttgcactgaaaccatgtgagcatctgtcagttaatgtctcctgctacagggactttgcacatgacatgccctctcttcttcatctccttgattcctactcatcctcaggtatcagctgagctgtaactttcatggggaagcctttattaatcactctgattaacttaattccctccatatagaataatctagctataataaaagagctaacaatatatagcacttactgtgtatcaaggcccattataagaactttacacatgttatttcatttaatcctcacatcgatcctatgaggtcggtactattattatcccattgtacagatgaagaacctgaggcatatatacctctcctccataccacttcttagagttggaattttatgtttatttgtacttaaaaaaaaatttgtccctctctgcccttgaatgtgagaactgtataaacagggattctatctgcttttgttcattacaacatccttagtgcctagtacaggacctgacagaattggagctcaataaatatcttcacctttggcagccctgagccccaggggccttctctctctgtctttgatggtcatccttccaccctctagtctgcatgtttgtgtagagttttaggatagggctggagtgtctaagagagtgaggctccacaacttctaggcagcctttcagctggtaggagcctttcaggctgtgcaagagtgatggggagtgatgtgggttggctgtgtccccacctaaatctcatgttgaatggtagctcccataatctccatgtgtggtgggaggggcgtggtgggaggtaattgaatcatgggagcattttccccatgctattctcatgatagtaagttttcacaagatctgatggttctataaggggcttcccctttcatttggttctcattcttctctctcctgctgccctgtgaagaggtgccttccaccatgattgtaagttttctgagggctccccagccctgcagaactgtgagtgaattaaatctctttcctttataaattacccagtcgcgggtagtttcttacagcagcgtgagaacggactaacacagggagcaaagaaaggggtatttagggttaaagacaaggctaactggatggggcagggtagggagagacattgagcacagctgcgggttgaggccagggccacagaggccaagccccagtgactgatttcttggatggttggagctgagctttaatagcagccttgacaatgacagtgatggaactcactaccacggagcctgcgcctgggtcaggcaatagatgggggatgagaagcaagttgtacatggtgcatgcatacattctgtgtgtgtgtgtatgtgtatgtcgtgagtatgagctgtgtgtgtacgtgtggttgtatgtacattcatgaaatagctgtgattttatataattgtatgtacattagtttgagccaaatgaaattgccaataaaagagcaatttcatatggttgagcaaaatgtatacacatatggatgaccataaatcatgtgaacatgtgaagcatttatggatattgcatgagttgatgctgcctgtggcacagtctcagtatgtgtgtttatgacatcattgcaagtgggcatgagctgtctaaggtggcagctcatgtatatgcacatggtgcatgtatgtacacatggtgcatgtgtgtggtggtgaggagaggctgatgaatgtgtcaagactgtctgccatatttggatagtgacacataccctctaataacagagtgagtagacatgtgtcttccaataattgagtaaggggacacgtgctctctggtaactgagtggccttcattttagcccagggataaggtgtatctcgcagaatacaatggacacccccaatgccccatcttgtgaacataggagacaagctgctccttggcttctccaggcactgtctttgatcagaccttatacaatacacattgccccatctcacataacctttatgcctaccattgcagggagagtacatcactctgttagaaaaatccccaagcagtcaatattacttgcttctggaaaatgaggaagaaacagtgtggcagaagttaagtaaccttggaatagcataaataggcatagacatgataaatagggcataatttgcagaatcaaatcctggatctagcccttactagctgtgtgactttggtaaacaatacttaaattgatttcccactgttaagttttacctagcacaacgccttagacatcatagtgctctttgccacagaatctggggtttgaagtaagtgtttcctcttatgcaaaaaatagttataaacatctactatgggagttatttttgctattcaccaatatttctgggttttggtctcttagacacgtgataggattgaatttccctttctcttttagtccaggtgtgccacgtggcttgttttggccaatgagatgagaacacagtgacatggtggaccgtttttaggtggaagttttaagaggtagtgcattaggtgccatgttttctttcccctgctttggctaagggaaatcctgcaggtgaagtcttcctcagcctgggtctttgagggaggataagatgcagcagggccccagcagacctatgacagatgtgctgtgtagtaagacatgaagctgttgtttcaatcccgaaattttggggttgcttttgcagcatgacctgtcttattttgctggacaccagttttgccttttggtccacctgtatggtaaatactcatcctcatttcacaaatggcaaaactggcctgagacatgttaggtttatcttcagtcagtcaacaggatcaaccttttggtttgaaaaaaggtgacatttgggacctttgctccatgagtactttgagtgtgccagaatggtgacccaatctcagagacatttctttagggcattggggtgttggccaagggagggcaaatagactctcataagtggagaagaatttgtacaatattttatgacctgattctgataacaaaggaagccccaaagtaggttagggtgataatggagatttaacttgctcctgctgggaaattcacccagcaagatgcaaaacccagaatagatcacttttcatttctcagagttacacaggttatagatgatcattgtataaaatttagataattcagataaatgaaagattaaaaaattaaaatcatctaggcttggcatggtggctcacgcctgtaatcccagcactttgggagaccaaggtgagcaaattgcttgagctgaggagtttgagaccagcccgggcaacatgacaaaacccagtctctacaaaaaaaaggaaaaatcatctgggtgtggtggtgcatgcctgtagtcccagctgctcagagcctgaggcaggaggatcaccagaacctggggacgttgaggctgcagtgagccgtgatcatggggccactgcactctaacctgggtaacagagtaagacctgtctcaaaaaaaattaaaattatctgatattctgctacttagagataaccaccattcatattcaaccttctaaacattctccatgtatactttaaaattggtgattacagtaattgctttatcttttatctcatttaacacatcataaatatccttctattttaagtaaatagggggccatatcatcattttaaatagctgcatagtattccatcatatgaagcatcaatttattagtatttcttaatgagtccaatacttttggacctttaggctgtttgcaagctcttgctgttataaacaatattgtgataaaactccttggaagaaacatcttctggcacttgcctaattatttccttagaataattctttgaagtaggattgctcgtcaaaagaaatgtactttccaagggcttttgttgcatattgccaaattgctgtccagaaacactgcattaattttcagtcctagcagtaatgcataggaatgtccttttcttgatttccacatcagtccagcgtattgtcaatctcttaaacctttgctaattctaacagtgaaaaattgcacttcgttgtttcaatttacatttctttgattcctagtgagtttagactatttttttaaaggtgcattgttagaataccttcttggtgatcctattggaatcccaagaatacagaggagacaatttgttctttcattcattcattcatttaacatgtttatttgcacctactatgtgctaggcacagttttagaagctgaagttacaacagggaataaggcagacccagtccctgtttcagagcctatatatagcagtgtgtgtgtttggggggactaggatcttaaccccagggacatcaggctcctgaagtactagcggagtaattatagaaagtagctactcagttctagtcagcatgggctcagctgtactacagccttaggcaaaaagaaaaaaatccataatgtgaatcctatctttattcaaattttgatattttgttcattatggatttttgcactaattatgattttaaaatgttgccatataatatgtattctgattgctgagttttcttggtgcacttttaagttctgtacctgagaaaagtgcctcactcatcttgctctaatctcggccctcctaatctatttctgatttctaaaatttctgtgcacacacaggtgagaccctgcaacctgaactcagggctttccagactcataaataagtgctgttctgactacacatccagaaagatttcaagtcagtccaataactattactttgaggaattgctgtgttccagggcctgtgtcaggccctgggatataaagacaagcactcagtcaccattttgaaggtgagatttagaggcctaagtaaacaatataccctgtaatcgtccatcagccatctctgtccttagaagtacatgtgagtagttatgccatcttgttcccatcctggtctcaatctttggtggaatgattaccacgttctcaaaggtcttggaaaactaaatgttaataatgttaacctaaacataaaataactgaaagctatttaagtttcccctgtgtgccaagcatgacactaggcacttgtagcagttaagtaaaagggagaatttaattatggagttgattacacaggtgatggaaaagttgagaagcttagtaggagagggtgaggccatccagactttattcaaaagtgggaagccactaccatctccagggctagagaggcaaagggaaatgatgtagttatcagggctttggggcagaagttgaaatatcaagtgtcctgttccacaggagctgaaaacatcgaggaggttctgctcttgctagagatgttgcctggggagggaggaagaagatgatggaaaaatagccagaattttccttcctcttgccttccagtctcccaacaggacttcccattggccctctcctgctggaagccagctgatcttgaagccaagtcagaggttggctctctttgatagagaggagagttagggaagagggaggaacagatctgattgcaaagaagtcacagaatagcatcctcctgaacataaaccatctttaaaaattctcattaccaccctgaagttaagtactcttgattccattataaaaacatgacaccagaaaccaagaggagctaagagatagctacagggacacacagtaataggggaattggatttgaggttaggcttgcttggggccaaggtcctatttttcccacaccacaggcttcctctctaccctgaatcatcccaccatcatccagggcatctccagtgctcctgagggtcacccctcccttgcccttgctttacagttgcttggctgccccatctccaatgactggcacttactctccatcagccaccatgttgcacaactcctttgaattttatgtgaatggtattcctggagttatccaatgggatggccctgttgacaactacctaagcccatgaccatggtttggatctagtcattatatttgaacacttggcctctgaaatcttaggttctaagaggtccttccctgctgtccttcttcctcctttctttcacttttgttgacttgcctttttgacctttctctaaccccattggtatttatttccctactctgagtctaccagcccttcctggattgaatccccaatatgcccaatctaggcttcattgttgtataccactcctgtgacctttgtctgatacactcttggcagtcctacgtaacctttatcattctttgctggagaaaaccacacaactgtggagattgagctcattacacacttatgatttccacgcctgcttagtgcccttggatggtcccctttgctcagctgtagtttaagaacttattttcccctgtagtacttacttctaacctcatgatctccccgtgggccccaggttgcctttttccgataaaggtcccaatgcctacattcatctgagccagctgggctgccagtggaaatgcgggggtgagaggacagggcagagcacaaagattcagcgtgtcttcacagaggtggtaatggtggtgcaggtgtaacaccagaggtacaggcaggaagactaagaccagatgttggccattttcttctagtgcatgcaaaatgctttattttcttgaggtttccaatttcccaagattcctaggcttgatggcttcataagggttaactcactatcctatggctctgccattaattactccagtggctgcagacactgcacggagctggatcctggttgttccagcttcagagtgggtttattgccaaccatgcattatgaagaactaattgtgagccccttgcacctgctggttccccctgtggctgggactcaggaagtggggggagagttattaatgagcttgttgctcattataataaaacaatggggaagttggcaaaggagctggtggtccaggtgtggtgtcagagaaggctggttggcatttctggaaacatgactttacagtcatatcatctgcctccttccctggctcatgctgtgacaccaagtgataaaagagctgtcatcctgagggccactcagagtccttgtgaactcatgatcagcggaagccacctggatggaggaattgctgagccagcactctgtcctggctgagatgggctggggcatggggaatgctgggatttcagccccagagcagaggggacagacctggctgtgccctgggttatctaggcttaatagatacagctgagaggagtggaagccagtggaaggccaccagaatgacaacctcttgcacgttgaagagctctggataggtaatggtttggggcacagatacagggctgggactagggtaaggcaagccagggtgcagaatttaaggaggccttcactctcaggcttgtgcaaattcagaagcagcattaagagtgagtgcctccttaatgtttgtgccctgagtgcaccctagtctgggccctgcacaggtgggtggctatactagaagggccaggtggtagctcctccttgacatcctcccttggagcttgaggcagatcagtggacatctcttcctggtcgttggttctccagggactggtctggaagcccactcaggaaagtactatgatgacaactaacatcaactgggcagtgccattattaattctccttctcatttaattgtcaagacatacatggaaggggggtaagaagaatattcttccatggtggtgaatagggcaggctcttggattacagtttctgccttcaagccccaactttgccacttaccagcccagtgatcttaggcaagatgctaataccctgacatcttggtttcttggagtgcaagtggcttcttctgttccttgaatatatcaatttgttttcacctggaaagttcttctcctagatatttgcatgatacttttttcatactattcaagtctcaggtcaaatgccacttccttggagaggccttcccaggcaacctcatctaaaggagttccttaccaccatgtctaaatattgttacattaaattattgacttcatagccattatcactctctgcggttatctttatttccctgatatctgtcttcaccatttgaaagtaatttccatgagggcggagattttcctatttattgctgtatctatagtgctggaactgtacccagaataggtagttgctgatataaaatgtaaataaatgaattatttagaaatggcacttaactcactgtgttcttgggaggactaaggaggcaatccatgaagagtttggcacatactaagtcctcgcctctgagattcaaggagtgtaagtgacttgtctacattcaccagccagcaagtggcagccctatgacccaagacccaaaatttgtgctgtaaccttctatccatcacaggttcccaggtgctttctgatgagtcagaaaaagaagctgggctgaaaactacagcttctctggaaaagagggaatcctggggagaggagagaagaaatctgtgtgggtagaactatcctacagctctatcgtgagaatgatcaggttgtcataaacaggaaagatattaaacacattttacagctggactgtgacaggctaataatggcttcaggagatagtctatgtcctaatccctagaacctgtgagtgttacctttttagataaagggtctttgcagttttgattaagttaaggatgttgagatgaggaggtaatcctggattatctgggtgggacctaagtccaaacccaaatgtccttttaagagagaggcagagggagatttgatataggcagaagagaaggggtcacataaaaatggagacagagattagagtgatgtggccacaaagtcaggtggtgatatgtgctattttgttagcatgatcaggcaaggattccccaaggaggcaacacttgatcatacacttgaggaagcgagagaatataccatgtgaatatctgtgggaaaagactttccaagcaaaggaaacctcatgctcaaaggccttgaagcaggagtgtgcctggtgggttttagggaaggtggctggagtgtagcagtcaaagaaaaaagggatagaaagtacagccagaggtatggcctgaggccagggcatgtctggccttgcaggcaacagcaaagactgattttattctaagtgtgataagaagccattggggagatttgaaagcagagagtggaatgctctattttatgttttacgaagattattctatttgctgtgtaaagaatagaacagaaaggggcaagagaagatgcaggaaacccaattaggaaactatttcggtctgttcctgttgctgtaacaaaataccacagactgggtaatttataaacaacagagatttatttctcacagttctggcggctaggaagtccaagatcaaggcaccagcagatttagtgtctggtgaagactcactttctgcttcatagatgatgtttcttactgcattcccacatggcgaaaggggaaaaagggccaggcagttctctgaagccccttttacaagggcattaatcccattcatgagggtggagccctcatcacttcccaaaaaggtctacctctaatacccatcaccttggggtgtgagtttcagcatatgaattttggagggacacatacattcaaaccacagcagaggccattgcaggcagaggttgatgatggcagcttggtctaggtgttgggaagaaggcggtaaaatggggtcagtgacgtgatacattttgaaggaagaggcttgtggtttgctgatgtattggatgtggggaatgaggaacagaggaatccaggatgattccaaggcatttgcctgagtaactgaatgaacgatgttgcttctactgagaggagaaatactggcaggagggcagatttaagggagagaatcagttttggttgtagaaggggagaatggtaaagaaagagcaattagcagggaagcatatattgaacactatgttaaaattcatagtgctgcacttcactccgcctttctcttgggtagtggaggccatttgaacttccagggcttgattggcaactccccaaaccaggtgagtagtggtggaaataaatccagaaataaacccaaaatgtattaaagacttaaatataagacctgaagctgtaaaactagaagaaaacagaaaacttccttggcaatgatttttttggatatgacaccaaaagcacaggcaacaaaagcaaaaataaatggactaaattaaatggaaaaatttctgcacagcaaagggaaaaattcaacaaaataaaaaggcaacctatggaatgggagaaaatttgcaaactaaatatctgataagggattaccatccgaaatatataaggacgtcctgcaatgcaatagcaaaataccaaataacctgattaaaatatgagcaaaagatctaatagacacttctgcagaaaagacatacaaatggccaacagttatataaaagatgatcaacatcacaaatcattgggaaaatgcaagttgaacacacgagatatcactttacacctgctaggatggccattattaaaaaatgttaatgaagatgtgaagaaaagggaatgctggtacactgtaaatgagaatgtaaattggtatagtcattatggaaaacagtacagaggttccttaaaaacttagaactaccatatgatccagcagtcccacttctggatatcaaaattaggaaggaacagaaattaggatcttgaagagatacttgcacttctatgttcattgcagcattgttcacgatagtgaagatataaaaacaacctaaaagttcactgttgaatgaattaataaagtatggtgtatacatacaatggaatgttatttagacttaagaagctatgttgtcatttgcgacagcataaatggacctagaggacatcatgctaagtgaaataagccagacacagaaagacaaatattgtatgacctcattgtatgtggaacatactatagtcaaactcacaaaagcagaaagtagggtggtggcttccaggggtgaggggagcggggaagaggaaatggggaggtaagtgatggtcaaagggtacatgtttcagttatgcaaaataaataaattctggagatcactatacagtatatagtgcctaaagctgacaaaactatattgtatacttacaaactttaaactttgctgagagggtagatcttctgttaagtgttcttacacacagacacacagacacacacacacacacacacacacacacatatgcacacactaatcaaggaggtggaaggaaactttaggaggtaatgcatatgtttatggccttgatggatatgtttatggtgatggtttcatgggtgtatatttattatatcatcaaactcctggagttgtatatgttaaaaatgtatagctttttgcgtgtcaatcatacctcaataaaacggtttaaaatgtaattactttcttaaaaaatgcctcgtacagtctggaccaggttaaaactttattctcacatccaattcattgcccatctcctttgctctcctggttgacagccaggcttttcctgggaaacagtgatggggaggccccgtgtctgcccttgcccctcttgccatctctccccatgtcttttctccctcttgaattgcttgactaggcagatgtctaatgagggaaggagatgtcagttaccctgcatcttcctgttatcccaagctctacaagtgatttctttgaagtttccatcccacacttgcttagagaggtgggaataactcctttctccctcaaggcgaagaaggaaaaagacatgattttctcccctcccactgtgattcacagtgtttcttctttcactttgtctcctctctcttggtcttctgcttatatggtcctggtagtggtgggttcagggagacctggatgagggtggcagaactgactggacagtgtgttagtccaggacctcctagaagctgacatagaaataggaatagatgtgcaggaggaaatgctttttgtgatggttacttttatgtgtcaacgtgactaggccatggggaacctggatatttggttaaacattatcctgggtatgtctgtgaaggtgtttgtggatgagattaacatttaaatcagtaagctgagtaaagcagattgcactctctgatgtgtatgggtcttattcaaccagtttaaggcctgaatggaacaaaaaggctaccccctccccgagtaagaataactcctgcctgactgccttcaaactgagaccttggtttttctttctgccttcagactgaagctgaaacatgggctcttctgggtctctggcttgctgactcaccctgtagatcttgggacttgtcagcctccataattgtgagccaatttcttataataaataaatataaaactatataatataattatatttatataaaatatttatatgaaatcattagcatgtctaaattttaaataatcctcagacaaaccacaaatacttcaaaatcgaaatgagaaaggggatataaccacagatacaaaagaaattaaaggacaataacaagacaagaaaatttttttttcattctttttttctaatgtattatactctaagttttagggtacatgtgcacaacatgcaggtttgttacatatatatacgtgtgccatattggtgtgctgcacccattaactcatcatttaacattaggtatatctcctaatgctatccctccaccctccccccaccccacaacaggccctggtgtgtgatgttccccttcctgtgtccatgtgttctcattgttcaattcccacctatgagtgagaacatgcggtgtttggttttttgtccttgcgatagtttgctgagaatgatggtttccagcttcatccatgtcccttcaaaggacatgaactcatccttttttatggctgcatagtattccatggtgtatatgtgccacattttcttaatccagtctatcattgttggacatttgggttggttccaagtctttgctattgtgaatagtgccgctataaacatacgtgtgcatgtgtctttatagtagcatgatttataatcctttgggtatatacccagtaatgggatggctgggtcaaatggtatttccagttctagatccctgaggaatcaccacactgacttccacaatggttgaactagtttacagtcccaccaacagtgtaaaagtgttcctatttctccacatcctctccaggacctgctgtttcctgactttttaatgattgccattctaactggtgtgagatggtatctcattgtggctttgatttgcatttctctgatggccagtgatgatgagcgttttttcatgtgtcttttggctgcataaatgtcttcttttgagaagtgtctgttcatatccttcacccactttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctctttagttcaattagatcccatttgtcaattttgtcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataagatgtaaggaagggatccagtttcagctttctatatatggctagccagttttcccagcaccatttattaaatagggaatcctttccccatttcttgtttttgtcaggtttgtcaaagatcagatagttgtagatatgtggcattatttctgagggctctgttctgttccattggtctatatctctgttttggtaccagtaccacactgttttggttactatagccttgtagtatagtttgaagtcaggtagtgtgatgcctccagctttgttcttttggcttaggatggacttggtgatgcgggctcttttttggttccatatgaactttaaagtagtttttccagttctgtgaagaaagtcattcgtagcttgatggggatggcattgaatctataaggtaacattcctgaacatccagaactcacatatttttaaaaacactagatgacttaagaagtgcttaaaaaacttggacaaataacatagaagaaattaatgaagttgttaaagatctctttaagatcctgagtcctgatgatttcatagtgaagttttttcaaatattcaagatatttcagatgtcattcaaattagcacagaagatagaggaaggagaattttcttaagtattataataattttaacataccattgatgccaaaatctaacacaagaaaattccagacctgtcttatttataaagatataaaattcctgaataaaacattgtttcatagaatttagcagtgtctttaaattaatgtattctaagtggggttctactaaggaataacaggattattcaatgttaagaaacccataattataacttgtcatattgccaggccagaaaatttaatatctgaatgaattctgaaaaaatacagatataatttcacattcatttttattaaaatttgtacttgagaggttttttttcccctcctgacatcaactaattctgacaccaactaggtatcctacaattcaacttgattctaacactaactacctggcattagctacctggaattagcacctaaactgcaggtttaggcactcagtctcacaagactgtcctcacttcagatgccagtcacaagtgtcaggtcgccaggttacccacacttctgtccaacttggctacaaagtcaagggttgccactccccattccctttaggcttgttaatttgctagaatagcttgcaaaactaagggaatcacttaacttttgtttaccagtttattttggagaatacaaatgaaccgccagatgaagaggtgcatagggtgaggtctggaagggtcctgagtacaggagcttctgtccccatggagctaggatgtgccaccctcgcagcatatggatgtgttcaccaacttggaagctttccgcttccaaaaaatcccctcatttaggatttttttttttatggcagcttcatcatgtaggcatgattgattattaactcaatccccagcccctctttcctgggttgtggggcttaaagttctaggcttctaaccaaggcttggtctttatggagacctgtccccagtctgaagctatctagaggctagtcaagaattgtcttactagacaaaagacagtcctattattattatcactcaggaaattccaagagtattaggagctccaggcaaggaaatgagaagaaggcccagatgctttttaataatgccttggtagttaataaataaaaaattaggtaatcctcattacaagaatgctttatggtgaagcaataaaaacaatcttgttaaatttaggaaagaggaaatgatactttccctcaactctcttatagaacattgttctagagatgcttaccaatgctattagagaagaaaataaaaatgaggtagacatctggcaaacaataagataaaatgcttatcccttgcagaagagattattagctacctggaaaacatgagagaatcaataggaaaattttggaagtgataaaatttaaagcatttggttgtaaatgcacacacacacacacacacacacacacacaaattctcaatatgtcaacagtaagtgattttaaaaatttctttacagcaataggttcatttttttttccctgtgaggaggaatcctgtctattgtaagagggaagattgaaacatgtttagaagaaacagaggagacaaagagcatgtcttggagatgttgatatccttagtgcctgtttttattaagccttaacttcattctgtccttaggtttcatgggatgcctcaaaattcttataataaatcctctttcagcttatagtggatttagattggggttctgttgcttgcaactgtagggagcctaaccaatgaaggcagatttgttagaaagcacaaaacacaatgaactctttgcttccctagtccacaacagttttaggatgcataaaatatagtgtattcagaaatgatgaggggtgagtgcataggtaaatgcatatagacaaaacagagcctgggggaaaattacaataatcttatactattagtctccccttcagtagcatccttgggatcttgggtctcataattctatttccttttaaaaagtcgtgcacatactgtcaacagccattaaacttgcttgctattgctgtcccttgatggcctcagtcaatagccccctatatccttgcctgcatagtcgaggctgttcttaaactgaggactatttaggaggcttacccttctactactagctctctcagctaggaatgattcttcccttatcgtgcttacaatgctcaggaagccaaattcttttaactcagaatcagtccctttctaatctgggacatggctggtccggaatggctagaagtttggagtctcaatcccaaacccaagggtacaaccttctatctcaaagtgttttccaggaatataggactcttggatgatttgctctggcagcccagaattctcaatgtggatttgcagattaggtttttcttcactgttcttcccacaatgatcaggcagtatatttaacaggaattactttacaactaaagaaaaattaaaaccaagacaaggatcccaaagctatataagaacaaaagacctgcttctaactggaagagaatagaaaaattataaaatctcactgtagctcatgatagagtgttccctacctatgagtatatgccatttcaataatttttaatcctttagactttgagtagggcagtctgaatgtaagcatcattttgcattaaggccagcagggatgaaccatagagaggagaaacattattgattgttataagttctcagtaaaaaaaataccctgaccttactctactgcctttccttacatatcttctgggtgcataattttttgtttgaaatctgcaatagggatggaggcagcatattagttatgatttttaatgatgatgcttataattatacagcaaaaaattgagagattactatgtgccaataactttaagtttattatctaattgaataatcacagcaactctgttattaccttccctgttacacgaagagaccaagattgggagcaggtactaaattgtcccttggtccaacaggggaataaggtagcaaatcatgtgaacctgaatggtcagattctagactcctggttccatcctcagatggctgtttggtggccttgactccctggattctagaagcaagcctatggctaatatccatgatatagtttggatgtttatccctgcccaacactcatattgaaatgcaatccacagtgttggaggtggggcctggtgggaggtgtttggatcatggttgtgaatcccttatgaatggcttgggccatccctttggtgataagtaagctctcactctgagttcatgagatctggttgtttaaaggtgtgtggtacctccctccaactctctcacttgctcctgctttcaccatatgatgtgcctgcccccgctttaccttccgccatgattgtaagcttcctggtccctctttagaagccaagcagatgccagcaccatgcttctatacagcctgcagacccatgagccaatggaacctcttttttttttttgtaaattacccaatctcaggtatttatttacagcaatgcaagagtagcctaatacaatccataacttgaagtttcccacaactctagatattctgggcctgcagctactttgggttcatgaacaaagagctgtatttcaggtgaagtattcaaaggagaggcatttccttatatttcagctcaatattttggggtgtaaggccaagcaggtatagacacacttgactgccaaatggggtgttagtaagatgcccttgctcaggacagatctactgatgtggaaagtgtcaaggaaataagaatctttaactaggaatttggctatcattttggtcaaggaagataaattttcagatcataaagggtaaagttaacattgataagacaacactcaaaggtagaagtttatagatagctcaaaactagttgaaataattttagcaagatgagtgatctctgggaaattgcagacccttgaattaatgatgctaattttcagaaatcctagaggagagagatgcctgaagcctggaaactggcaaaaaaaattccatttttccttaagggaagaaaggtgactcaatcctgggcaggaatctagtatgatttatttagggcaagattgtaaacatattggagatcactagaaaccaatattgactcacttagaataagttataggaggataatatcatttcctttttagatagtgtcactaggctctcagagtaggatagtgacatatctgttaggaattgtacttggctttgaataacagaaaccaaaagatgagtggcttaaacagttaagaaattcttcttttttcctgcaaggagaagtctagtagcaggtggtctctagcattgatttcagagacccatgactttcagggctacagtgcctgtgattgtcttgacttctcccttatggttgcaaaatgactgctccacctgccacatcacatcagtatttcaggcaggaaaggcaaagaacaaaggatctgtgtcatctgagctggctttttaaaagtggttttcctgggagggctacccaataacttccatctcattgaccagaactatgtcacatgaccactgttatttgcaagggaggctgggaaatatagtatcttgacacattgcctcttgacaaagccaggaagcataggtgttgggtgctaaactagtaatctctgtcccatgaagcagataactgatctggctttcagcagaacataacaaaaaaaaactttagatatccttagagagaaaactgaaaatacaaatagggtcttagaggatcttggaatactaaaaactagtttacccattcagagcagataaatgaattgatatcattttgtggggaggactttattggagtgcctatgggctctatcatagccctgatcatattagcactttaatgatttgaattgaagacatggaaaagccacttgcgtgatttgctggtgaaataaagttgaaagagaaaatgtgtgaagaagctggctgaaaaaatcagtatctttttagatcttggttgcttaagtgcggccagattttattaggtgaatcagcagaagaataagggagggtcctgtgttgggttgcagaagcggtggtccaagtgcaggatcagggagctctggcttagtgaagcaggtctgtaaggtcttgtgggcttttagctcactcttgactttgtatagtaatcaggatgatgtggatccacaagtcccatttaccctcaagccatgttaatagaaatatcacaagagctgtgatccagggcagagaatgagaattcagtggaaggagagtgtttgacccagagatattcaggtggtacattaacctcttaacttatctcaaaacattttagagattaggggaagtatagttgaaggaagggggcctggggtgattaaaaccatttatctatggaaaactgcaggacttggagacatctgaggagctgaccaaggatagaataagatatccttggagatggtgagttctctgtcattggaaatattaagctgggaagggagcctatagagatgatttaagcattgggagggtaaacagactagttgcactgttacataattccctttggctcatgaggctgtttgattctccaaattttctggtgacccctggggtcacatgatcagtagatatactggtcaaaaagttacatagctgctggcctaaggctctcaagaggctgatgagacactgagcccttccaggaggggctaaaacactgatttaaaaccctgagatgaaatatattattttcaagcagtctataggtttggccacagaaggataaattgcactggaatttgacattagctaacccagtgggaggttgaggggtcaacagaccatcctgtaaccttgagtcttcttgaaccttgggaaaagctggctctgggctggagatgactaggtgtggccaggaccttgattttccctctgcctcattgtggggaaaccatctgtggcttcactatcattagtttacatgggtatgactatggggtgtgaatgaaaagagcacttaagttacctaaacatttatcgagcacctactatgtgccaggcactgtgctggagccagggatgtggagaggaatcaaatacggtccctgggatggaggagctcacagatcagtgatggaggggaccaaaaaccaaacagatcctaataggcagagggtctcgatagacacttataccaggtgcgaggaaatctgttgtaattactcatgcctggaatagggcatcaagggggccttcccaaaggtgagctgtaagtggggaggtgctttagatagataagagcacaggctggcctttcctggtggagggacagcacatgcaaaggccctgttttgcaatgtcctggtgtattctgggaatggtaaacttttctgggtggctggaagagcaaggttcatggtgagcaaaaagactcagcaaatttgggactgatactgaatgccatgctgagacatttttactttgctctgttggcattcaggagtcaccccaggcttaaaagtaggacaaggaaatgatcagatgtatcttctaaaaatcacctcttggttttgtggactggacagggatgaggctgggagcaggaggccagctggacacagggttcctgcatgggctacttctttctttgccaccatcaggctgttcccagattggatgatccatggaaagatatttgcttcttcatcatttcccctttactttcaggacctcatcagcttgggagaagtgctctttgcctgcttagtaatcccatgtagggttatccaagagaaccccagggcatagctgaggacaggggaatgagtcactatttgtcattgtttgccacataccagatactttacttacacaagtcctttcatttgcttctcaccatggctctgagtggttgcaattgtgcttcccaagtggaaaatgatgctcagaccaaactcaaggtctcagaacctgtaagtggcagagctgggatttgaacctgcctctactgactctcagtccagtgctgttggctgctaagggtccctgtgtttgcctccccatggggctgctggggaaggctgtgtgtttgtgtgcacctgaagctgggcagcctgtgtgtctggagggcccatcccacccggaggcaaggcagggaggcccatcagctctctggtggctcccctttgctgtcttcgacctgtctcctgcacagattaattgctgctcacccgaggtgtgatgtttcctggttccctgttccggcaagtgtgggttagtggggagcggtgcagccatgctgatcgggagtctgcactggcacagctggcggcctgcacagcaccctcatcggaaagtgatccatcacccgacagtcgtgttgccatccaggcccagctgccaagctggcatcttgaggcctccccaggtgtgacaggcctcccggctcagagcctcagggctgggcctgcgtgtctgccccttgcaggactttcaaaggggagtgggagccttgcctgactaaggcttttactcttggcagctttggggaaagcccccagctgaaatgcggtgtttccagtggggaaagagtaatttttgaacatagcccctgttttcccactgaaagctcccaagaggagcaagaaccccagaggcatgatgcttcttagcacccccaagtagttccacagagactggtgtgtccctcatatattctcagctgagatggagctggaaagaccaggcagtgttggggcaaggccctgccagactagcaagtgaatttgcgtggaaggagagaggtcgggagcctgcctacgttcaaagggtcctcgcggttcctgctcctgagatttaggtgggattaacttgaccttctagttttaaatcagtacttcttaaatttggccatgagtcaggatcacctacagggcttttaaaaatgcagattgctggccccaaccccagtgttttcgattcattaggattagggtggagtcctacaatttgcatttctaacgtgttcccaggtgatgtcaatgccactggtccagggaccacactttgtgaaccactggttaagggggaggccaaccccctttttaggctctttaagaatttgcagaagtctaagctctcctggtttctttgggttgttagtccctgattaattttcttgtctccccaggccacatgggctgtcctagggctaaaatcagagataaagttcagttccttctgatatctaacaagagcccatgagggtgtggcaaccaaatttggtgaagtccggggcagtggaagcaggatttctacacgagcaatactgatagctataattccatttagatacttgctgttttaattatcctttggccacgaggcctttgagagcacaacctgagatgaaatatacgaaagatctggcttacagaaggtgtttcatcaagcctcattttcccccatccatctctgacttactagtagaggcagatctggatgcaattgagccccagaagaagtttggggaggagagtcttgagaataactcagtagcagttccctgttcttatagcccaccattggctgaggataaaagagatgctctctcctgggtccttaaatgcccccagaggcagagctatcttctggatttggctcctttcacattttgccaatgccaggagatggcctggctggtaggtcccagctggttgaccttcataaagactataggctgctcaaaccactttctttaggcaagatcctcaacttacctttccctctcatttcatctcctggcgtttcatcactgtccagagctgactactagctgctggatgtcttgcaatggcaaagtggtccccatatttttcagaactttgggagggaggcaagggcctcagatacctcctggggcttgaactccctgaaggatttatagatttggttgggagcttcaagttgagtcccaatgatctgtgtaaccataaccaccagtgttccaccctccacttcccacctgttacctaccattttcaagccttgtttccaacactatgcataggcacatgtccaagcttagcttttgtccttttgaattcctaagaggaatcatttaccctgttcttttgtcttagtacgtgtgattctgcaattagataaatagtcctgattccttccggcacaaacataagaaggtacttcaggagaagagacaagaagtatttttttccagagtatttattctttgcatgtattatttgctccctcttatccaagggggatacattccaagaccccagtggatgcctgaaaccatggatagtactgagctctatttttacgatgtatttttcttttttcttttcttttttttttttgagatggagtcttgctctgttacccaggctagagtgcagtggcgtgatcttggctcactgcaacctctgcttcccgggttcaagagattctcctgcctcagctgcccgagtagctgggattacaggtgcctgccaccatgcctggctaatttttgcatttttagtagagacagggcttcaccatattggccaggctggtctcgaactcttgaccttgtgattcacctgccttggcctcccaaagtgctgggattacaggcatgggccactgcgcccggccacgatgtatttttctattcgtaaataactatgataaagtttaattgataaattaggcacagtaagagactaactaatgaataataaaatagaacaattattacaatatactttaatgaaagttatgtgaatgtgatctctctttattaaaatatcttcttatactgcagatcttagcaatctcagcatacaatttttttcttttccctagtaagtagagaacttgcatcttttcacttaaaggaagcacttcatggcttctttttggtgtatctgaattgccagcatcactactcttgtgctttgaggttactcttcagttaaataaaggttgcatgaactcaagcactgcgatacctcaacagctgatctgataactgaggccactactaagtcactaatgcgcagtggagcttatatggatggatatgctggacaaagagatgattcacatcctaggaggaatggagcaggatggtgtgatattttgtaatgttactcagaatggcatgcaatttaaaacttatgaattgtttatttctggaattctctattgttttaagttcaggggtacatatacaggatgtgcaggtttgttacacgggtaaatgtgtgccatggtggtttgcagatcatctcatcacctaggtattaaacccagcatccattagccatttttcctgatgttcttctccctcctccctcctaactctctgacaggccccagtgtgtgtccccccaccatgtgtccatgtgttttcatcattgagctcccacttgtaagtgagaacatgtggtatttggttttttgttcctgcattagtttgctgaggataatggcctccagctctgtccatgtctctgcaaaggacatgatcttcttttttatggctgcatagtattccgtggtgtatatgtaccatattttctttatccagtctatcattaacgggcatttaggttgattccatttctttgctactgtgagtagtgctgcaatgaacatgtgagtacgtgtatttttataatagaatgatttctattcctttgggtatatacccagtaatgggattgctgggtcaaatggtatttctgcctctaggtctttgaggaatcatcacactgtcttacacaatggttgaactaatttacactcccaccaacagtgtaaaagcattggaattttctgtttaatatttttggacctcagttgagcaccactaaccaaagccataaagagtgaaactgcaattaagggggaactattgaaagtgggatgtaatctttattccctgttgcatcccatgcttgcttatggtaccacctaggattgcaatgatagctaactcccaatccccccaaatcattgcatttggctggagttgtgggtatctttgctagctgggtactagcctctgattattttttccagctcttttaagggtagggggatgtgaggcaggtcaactataatggaaaggtcagagtggctggtatagactgcttctgatagggcttatggttagcaaagagagcagtttttacattaactaggataattttttcacaaataatataaatttaagacatgggtgattgcattaatcacttttgctttctgtaaccctctaaagaggacattccacaaggcatggaatggaaagaggaggttacagtgtgacacttgaacttaaacccctactatagagacaggagatagaacattggggcttttgatagctaaccctgagaaaatgcctccatctgccccaggcttgccctgcctgcagccttaggagatggtagccccaccaacctttcctgtgaatttgccagtttctctttgcaccaatgcataacgtcaaatgaggggcccccaccagggtgcctgctgcttgctgccaggcactcctgatgacttcagctaatttctgaatctggaaacattgttgacaatgtgatttctgaaacgtgaaaggcgttatctcattgtgccatctgcggcatgtctgtctgagtcggggcttccgctgccactctgcccccttgcagcacctctcactgctccgtcatcatctcccacagctaattgctccaaactgacaaggaggcttttttcatttagagatacagggaaatggaactttcttgctgatgtttcctagtcaagcatgctttttggaattctaatttgatcttttggttgcgggtgggtgagtggggtctggtttcagcactgggtcagggacagctcccagagaagaaggaagtagcacagtggggactagggtggaaatctcttctgcctgcaaggccgttaattgggaggtagtaaattctctgtcactagaagtgtgcaaatggagatgaatttttttttttttacttgcatggaaagctctaaatggagccagtctttgaatgggtgatttcttctagctcaagggatctcctggagccagttatatccagggggaggtgtgaggtaggggaggataatcaaagggtcagggctagtgtagtagttatccatagctgtataacaaatcactttagtactttaatagcctgaaacaacaataatcatttattttcttgcatggattttgttagtcattaatcaaggcagggcacaatggggattccctgtctctgcttcaagttgtctgagacctcaccttgaggacttgaagcctagggtcctagaatcacctgaaggtttgcctgtggctgaggatccattgcaaagtggctgataagttggtgctgactgttgatgggagacctcagttcttcctccacatgggtttcttcagagggctgcttgaatccttgtggctttatggctgtctttccagaataagcaatccaatgccatttatgatctaccctgggaagtcatgcactgtcgcttctgtagtattcttttggtcacagaggtcagcttgattcagtgtgggaggaaactacagaaatgtgtgaacaccaggagtcaagggtccttgggggccactttggaagctggctattacatctggtaatagagagtgaagcaaggcacacagcttctattgattgagacagtgaagacaagttctgagcttgctcatattttagaagcaggaagttggcagagggcattaagtctaagctaactcaagtttttatgagacttgttctcctgtctctttgcacaggcgtctcccctccagaggcatctacgctgggctttcacattttgcttccagcactgacctttttcttgagcctttgattcatactttcaactcactccaacctctctggcctccatcagcttcttgaatatatcgtgctctttcatacttcagggcctcttcacatgctgttccctcggctaggaataccatccctaatctgtcttcatcactctgtcactggttggtttgtgttcattgctgagatctcagctcaaatgtcactttctctgagcagtctttgcttagctctcctgtggcagattatattttccaaagatggccacactaatatatctcccatcccaaatgctttttttacaatgtgatgttgacatttctccatcaagaggtgggtcagtgttacattatatagaacttggggtggatgtttgtaactgtcacaatcagtagaaagtggcagaaatgatgctgtgtgacttccaaggctaggtcttaaaaggtagcatagcagctacctggagtgctgtctgtcatctctgttcctctcttcccttgtccatggtaccccccaccattttgtgaggaagctcaagtagcacctgcgaagagaccaccgggagagaaatttaggcctccagatgacagccagcattgcccatcgaacatacgactgaatgagagttcagataatttcagctccccagtgtttgagccttccagctgagatcccagacatcatggagcagagataagtaacccccacaatgcatctttggaattccaactaaaagaaactgcaagagataataaaaaatgaatgtaactgtgttatgaactgaatattggagttatttgttatgccatcaaggtaactgatatatctgcaggctccaccaggtttccttataatgtgctgtcctagcttccagtatgtttccttcatagcattcttcaagagtttgcacttatatatgtgacttgcaactaatttcaattcattcccatctgtttcactggacggtaaaatgtatgagggcaagcaccatataaattttgtttgcaaacaccctgctagagcctgacatataatatgtgctcaataaataatacgtgctcaatgaatgtgttaaatggatacatcaatggataatctttctccctgaatttgccatagatgccccaatctctgcacatacgagttgaagacacatctttgtcttcctcttacatcttgatgaaggcaccattacctcttcagatgctcaaaccacaaacttggaaatcatcttggtcttttcccatctttttactgactcccataaaaggttctgggtcctgtgcattctaccttttaatactttattattccacccccatttccccactttagttcagcttcttatcatttccttcttgtatccagtcaattgactcctgttcagtttacttccttccaatgcatcatccaaactggcaggttgacctcttcacactgcatgtctaagcctgtcactctttggatgaaaattgttcactgacattattgtccttacaataatgcccaaagtcctcagtagcctcctcaagtcatttatggagatgggtgtgttataaattgaaactccttgctgtggcctgcagttcctcaatgatctgtcttgagatgatctcttctccctcatctctctttactttcacccccagagcacatgctgtaaacacatcaagatcttgaggtttatcccaaatcacctgtattaatttggttgaaaaagacagaaattccacttgagctaacttaggcaataagagttcattggctcacagaatctaagaaaacttttgcagggaaggcaggcagaagagtgcccaggagtaactagatcaagaagtcaagcagcttctacatatctccagtgttggcttcattctctttcactacagaagagcttttctatgttgcttatttattattgcattaacaagcatttatcattattatctctcatggttctgagggttaccttggcacagccagttggctaatcctcagttttttcatgtggttgccatttgactgatgttggctgcagttgaagtcatctttcttactctcatacctggcacctgggctgagggatgagatagctggtgctcctctgctatctgtctctaccactctgtagtctgtctatgtggtcactctagtatagcaatttcagggtagccaaaattcctacatggtggctcaaggcttcagtgatgggtgtccgaaggaaaaatggcagagggtgcatggtccttcctaacacaaccttgaaagccacttctgccatagtctatttatcaagttagtcaaaaagtgttgcctggattcaagggaggccccctcttgatgggaagggcatcatgtttgaacatcaccagctttgctactggaaacaattcttgagttcatcatcttacagtttcagccaccacttgatcttaagttaaaatcctctggtggggatctctgagcctatcttgtgttgggtgactcaagcccagtggactgtaagagagtgaagtcttctagaaatatggcaactctttcatatggatgagtatggcaggttttgaagtggaggtggtaccaggtaggcagtacagtgaatgatttgtacatggctccaaaatctgaacatagcaccttcccatatttgctcaagctgtgccttcccaggagcaccttttcttccttctttccatcctgttcacttttctttgtccttcaattctcatctcaggaaccacctacttcaggaagtcttatcttttttgacccccaaggttagtttatctatttgctcctctcattaccaaaggtatgcttactttcgttttaaaactaattacactagctcaaaacctacctgccctcttttatcatctgtcttcctcaccaaactgtgagcctctctagggcaaaacttgtattcctagtgcctagttcagggtccagccctttgtaggtgcttgatatttgcttttggaatgagtgaattaatctgagcagtaaggaggctgcccccagaatgaactgctgtgtcctctggtgtgaacatatggcccagctgctgtgtgctggggtaaaaagaggccaacttgccccacagctgcctggggttgagcatctgcaggctgttttgggagctggcctgacagatggaaaagggctgaagtcccccaggtccataagttgctcactccttttgagcctctctgcagctgaagggccattgggcaggggcatgaaaacatctgggagaggaggttgttccaggaaagcatctacgccaggtgtcaagcttcctgcagatgaaataaccagtcctgggctggagtttctgacatctgctcgtgtgagggcttgaggtcagggggccctgagagatgatgctgagaataggcttgattgtttggagcaagtcccccaaatcagagatttagggactagacagacataataaaaatgagagtggccactgatggagtacggactatgtgccaagcaccatgtcaagctcagtgcttgtgcataaactgcttttaaccttaagaggcaggaactcctattatttctattttataaaagagatagaagttccgagaggtaaagtaacttgtccagaggcccacagctcaaaaagggtagagtcggggtttgaatctgtgtttctgactgtgtgagctcaactccactcatggtgctctgattaaaagggcccagactcccagtgagaggtggtgaaacagactccttcagatacgggttctgggaggatgttggctaagacatagagtctttatgtttctgggtagttgggcccagtagacttacctctgctccccaatatagaccgaagccaaggacttgggtgcatgtaatttttttttttcaggatatgactccaggaagcacagtaggaagtgtgggcatgagaccaggaaaggaaggcaggcaactaagggtacactaatgagcctggtgggacaactgggctgagactttctgaggacctgtgtagagctcaccttataattgttccacagacaggaaggaagctgagtgtttgttcatctgttacagtgcctcattggttgagggttgtttccaggggcaagatctccctggctgtttccatctgatcctctttatccaacatgagctgaacctgctccagttacaaaaggaagctctcaggcacagagatggagatgcttggggtaggaatccattggtaagtacggaatctgtctacggaagctgcaggtgactttgaggttgcaccatagtgatggggcaagccaccaacagtgtctgctacactagccctacctgtgaatgcccctacaaatctgtccttcctccatcaggcatttctgggtgctcccgggaggtatcttatatgtgttcttaatcttgatcagttattgcttcctcctctgggtcgtgctgggcactatcattttccccagccctgcaaagacaacaggtgctgtgtcattctcattctctgagtattagtgggttctttagactctcattcccagggaatatctgctgcttgctgggcatttccactacatctgctaccttcaacagtttttcttttaaaccatagtcctctcttttcctcatgtagaaaagaggcctcttgggaggctgtggtgggaaatctgagagacaaccactgccatgttgtacttgaaataccccagacctctgattggaagtcaacagcagatctcttccctttccttcagttctagcacagtgagatgcatgggcaggggtacagatggttcaggaagctctaagcctagtgaattggttaggaaaatccccagtacatttgttttgtatttttcttcaaaatgagggagttggcaacaaaacgtgtggaaaagtcattaggttagttcatgcctcattatgataacttaggggttttcagaataattccttcatttatgtgatgaatattggttgagcacctgcaacatgccagataccatcctacttgttgcattgcatgtcaggcagggcaggcaaagggtgacacaatggactctgatcagacaggaaggcaaggaatctaccagcaggaaaagataaaatctgaggtacatctagggaaacatagtataaagatgaagttcaaggtgtggctataaaatcctttgcaaagatctcaggaggattgaaagtggtgcctcagagagccatttagtaaataaaaaagggctaataagaaaattaagggtatcgtctctcagcaatctcagcagtatcccaagatagacaaaggcttggagatttgtaagcttgtcctttgtctaatgacatgaaccctagtttcatagtagaaccacaaaacttttaagggcaatgtattggcagaaacactgcctgctaggactgaaaggaacagaagtagtacaagatgaaaaagggcctttggacccctgtctatccctgaaaatctctgtttgcagagggtaagagaagggaagcacagtcctggcctctggcctcacttgggagactgtttctgttccctggctatgcatgaagaatgttcagcttcccattctcctgtagaatttgagctcttcacccttagtacctaattatagttccagtgcctggtgaaccttgagcttcagcctgtctcagaattgtaaaattttcttgcatcactagtaaagagatttgagtattatttctgagcatgatcatggctattttaataatttaatgtactttatgtgccgtttctatgagtttgggaaagagaacagatcattctgtgacctggaaagcagtccactagtatttaattttcatatctcattgaattctcactataaccctgcaagagtactcttattatcttcctcctttaaatgagaaaactgagactcaaagagattaagtgtcctattcaaagtcattcatatagtaagtagtagttgattcaggattcaaacccaggaaatatgacttcggagctcatgcctttaaccactgctgtatatgacagaacttctcagagcctttaatatgctggtgggtattattaatgtccaaaagtggttatgcagaatttcccaaatttatcttaccctatcccttttgagtttcttttactactacagttctaaagacatactttgtgaaatattgcagagattgagcagataaaacttgagaagttattgaagtaggtgatgtaatagtaagcttttgttaaatgaggccatggtaacaaattcttcaaatatcagtgctttatcaaacaacaagattttatttctctttcatgtcacatgttagaactatagtttggctgcaccttcgctcaatatgtctttcattttggaacccaaggagaaggaattatcctaatctagaacataccatcttcatgacagacagaaagaaagagcaagagatggggtagaaacttgcaacacatcttaatttcatggatatggtatatgttacatttgttcacctgccattggtcaaagcatgccacatggccaaaaacaaagtcaatgagatgaaaatgtgtacttcctttactgacaatagaagggtaaataattccaacaataatgcaatctaccatagaaaacagaaccactgagagccctcaatcaaacaggcattttcagtagcagagaggagggaagttggaagctgtactataaagattttaggaaaagcacaggaggtgtgataatatgagacaagagaaagcatgtggctgaggatttttatggtttcatgtggctatgtgggtgagtaacagagtctgtccagcatgtccagcctaggacataggagaaatgtgagggtacctggatatcctgtctggtatcaacacctgccagccacccatgttagagatgtgttgctggttgctcattcttatatgcctcacacattctgagagctctttcaatacagtttttgaaactacttatatatcttcatttactttccttccccctttcaattgctccctaatcagcagtggatgatgtccaccctataacctgaatgtgatgtcatctttggtatcgtttaagaaatagcacttaacagttgttaactatgggaatccatttttagaacactgcttatcttctccttctttacaaaggtgattaagatttatttttacttggatgaaaacagccttcattgatttctgccccatagagagatgacaggacacttgcattagtcagagaggaagttaaccctttacttactgccactgaggcaggctacacaattcctcccagggcatgtacagtgggcaaacagagtcaaaattgtcttgttttgtacagaagcagcaaacccagaaatcagagaatgtgacttctctgtgctcagtatggaggcgattctgagaattccaacttgtgggaagctttcttcctggttgactaccaggggagagtgtgactgactccaaaccagctctgtgagccttcctttcttttagtatgagagctgtacttccttcctctccctcacacacaccctggtacgtctgcattctgtatccttgtatgacagagacacttccacatttttagatgttacagcaacaccctacttctaggtaccaagatctatattgcttatctcatacttggttgctgaaaccaacacaaatttattatcttatacttctggaagccagaagcctgagatgggtcttagggggctaaaatcaaggtgttggtggggctgcattccttctggaggctctggaggagaatccacttccttggctttttcaccttctagaagctgcccacattctttggcttgtggccccttccattttcaagtccagcaacaatggctagtcaagtgtttctcatgatgccatctctctagttatgattcttttaccaccctctccccatttaggaacccttgtggttacattgggtccatctggataagctaggatgataatcttatcttaaagtcagccgattagcatctttaatttcacctgcaaccttaacttctcccttgccatgtaacctaacctcagaggtcccgaggattaggacgtaaacatctttgggaggctattattctacctaccacaacatctaaatcttttgcccctgtcaactctgcaaatggagatgggttttaacctgttcagagatctctagggggtcagggacataagagaaatatacagtgtatcacacaaacaatttcaaattaatgttatgttactcttattctaaagagttctttggaccctgcaacaatgtgattttctcagctttgctttctctgtagctcccagccacctgttagattgatggttaatattttcgcatcctgactcatttctcctcaattaaaaaaaaattcacaatctttctgctctattatgcagagcaatttgttttcttgagtctttatcttagctcactgatcatgtctttaaatttttgatagtttggcattaatcttgagttttaaaatattgcattaagtattatttatcttggttattgagttttttggtgccctttaaaattttgcacctgagttgagtgcttcactgtagtctgggccctttactccctatacctgcctcaccttgtccccatcacactggtcagaggcagcccctgctaagaggttcttatgtattattcaaataaagttccatgcatttagatatatctgtaagtctgagttagacatcagtttcacacaaacatatacttattattccctgttctgcaactggctttttgcctcactcaatgtgttaaaaatcttcccaaaaggttgatatattatagctcagcattatgcttttcttttttttttggacggagtttttgctgtattgctcaggttggagtgcaagggcacgatcttggctcactgtaacctctgcctctgcctcctaggtcactcctaggtctgcctcaatcgctccttgaagtgattctcctgcctcagtctcccaagtagctgggattacagatgccaaccaccacacctggcaaatttttgtatttttttttagtagagacgaggtttcaccctgttggccaggctagtctcgaactcctgacctcaggtgatccatccgcctcagcctcccaaagtcctaggattacaggcatgagccaccgtgcttggtctgacatcatgctttttaacacagctcagaattttcacttttgtgtattttcctaataatttgtaatgacgttgtattttttctatacaagaaaacaaaagaatatttaaaatagtagtgaaaagaatagttacatttattgagagactatttaaagtgccagtactatttaagttgttatgcattatcttattaatcctgttggtaacgctgtgggataggagtcattattgtaccttacagatgaggaaactgagatttagatgaattaagtaacttggctcaatatattacatccagaggtggtagagccaggatttgaatgcggatttatcttccttcaaagaccgtgcttttaaccacactctttaatatatcaaagtatttaccaaggcctattctttaaaagacccagtagaagccccctgagttacattcagtgatgagaataacgagggcctcatgtgaactgttaaacaacaataaacttaacagaggacagagttatgagaaatgccatgtggggctgactggttaagtatcccaggagtggatcggatacatttgcttatttttccagagttcgaagggagctgtgtggattgaacagttagtgccagagactacaaggtgcgtttaagatgctcccaggacaagcttcctttgctccatcttagaacagtaaaagttagctcagtctttcttattcggtgctcctctccttacgtgagattacttacattcctcattctttttcctggcccagtactagattctgatattggtttctggctgtaacagtcataatactttgatttgcaaataagagaaaagtcaatttacattagcttaaatatcgaaggaagtttcttggcttatgtaactgattagttcagaggtagcatgcttcaggcatggtttgatcagagttctggctatgtttcattgtgagttatctgtgctggtattgtaatgtgtcaactggctaggctggactgacattttcagaatttccttttctgcatgcttcttattagggtagaccacaaaaggtattttcaggtaagataagagggtggaaatgaagcagcagtcatttttgtttttgacactcagaaggtcggagcaggcatatggagtggggaaagtatgccagttaacctatttcataatcacatgctctatcgctgttcctgaagctatgccaaggtagctgggtttggaagtgtttccagccttggtttcatgttccagaattgcaaaacttcaagacaagtgttaacttgggccatgaacccaggctttctcttctttctggtgaatcttcttttaaaatcttgttgtccttacatttttttttctattaggcagaccatctcggtcaactcaaagttgttctagtgttgaatctacttcctaggttcagttcaggatttcaatccccttcctacaaggtttttagctccttggtagattgattcatttctcccttacaaagatgtttctgcactcctgggagctttgggaaagtacattttgtcgggtgaggagaatcctctttattcagggttaagtgtctccttggacttaacttgcataactacaagggacacccaagtaactcccaagaagtgagaaagcagagagctgcagagtgctttgctggtctactttggcagagaagagtcctcagctgctttcccgagagaatttaatttaatttctaccttaccaagcaaccccttgtatctgaattgactgtgtctttatgggatgatctctcattgcacgccctgttgatgcccacgaggttgtccctgggatcttggacacagcctagagtccctttcacatacatgtgaataagtagagtgacattcattcaataagtataagttatgctagggaagccatagggaagaggtgagcttggaagaatgggtaggattttggaagaggagtaataaggaccttgaaaaggaggaatgacatatataaaggcataaaggtgagagcagagaaagttccagttcttggggaggtgatgaatctggaaggagaggcctcagccttggccccaccactgtttgtggggccttagtagaggatactcttgtgtgctgtccagtgacaaataagaaacaagcctggatttttttttgttttttttcctgagacagagtcttgctctgtttcccaggctggagtgcagaggcacgatcttggctcactgcaacctccacctccctggttcaagcaattcccctgcctcagcctcccaagtagctgggattacaggcgcacggcaccacgcccagctaatttttttggtatttttagtagagacagggtttcatcatgttggccagactggtcttgaactcctgacctcgggcaatccacccgccttggcctttcaaagtgctgggattacaggcatgagccactgcacctggaccaagcctggatttttaagtaaggagagactttgttcagctaataatgtatgagtcaaagagcgtgaatttggagagcctttggccttgtcataggtaaacaaggagagggcacctgtgagtcttacctaagacatgtggggcagggtgcaccattgcaataatctattttctgggacaccaaagggtgggagattttttaacttccacattttccaagatcacagggcttggataaagttcaatattgtcactggattctgatggatcccttttgccgactctgtgtgcccatcccccagcttttgtgggctttgctgctgactgctcactcctgtgaccctcttcagagggttgcccttgggtgcagaagcccataggggtggggataggttcctccatcacagcctgaagtgcctgggactttgttcccaccattgtcatgactggtgtgggagtacaaaggcctagctcctgtgtccaaagctggacacagtctaaggtgcaactcactccagaactccatggaggatgaggctggggctgaaacttctccgaaattgcacctttgttcagcttctttcctttttctatgttgcttccttcattccctgactggtttcttcttagagcacttctttgacaaaccttcctacgctcaaatcttcagctcaggctttgcttctgggagaactcaacccaagacagcttcaggtttcccattggtagaatggaggccttgggatagaccactggttttagagctttgctttgactacagatccctttctatacatgaagatctatgaagaagtccagaatatcaaacaggttagaatggaactgctgaagttgatgtggggcagtgtccctgcatcccctcctcactattcccaccccccttctcaactttggtagcagtcctgctctaccttgcagatgctacacccccatcccaccttcttggggctccatgggcacagtgcaccagctctggactggatggtaatgtcctctagctctagctccatgatatccttggcatcaagtgacagcaattgttgctgcagacttcaggtcaggagtggccttgcatgctcctgagcccaaggtgctcctgatggtactgccagtgtcctcactggggcattttatcctgcatatcctcctgaaaggcaattttatcctgtatatcctgcttctggccaatccagtagccccacagtcttctctgagaccttgagtttgcaatgaggttcccagagactggaacctcacagagttcctggttattgctttgaatttgcacctgtggatttaactcctggtgatccaaaggcaatcaactttggggtggaacttcatgagttggcttcctaggagagaattggcagtggcagctagaggaagtgtgtgagaggctctgttcagcagggtgagcatatgccttgctcattcgaggcactgacagtggcagaaaccaaaggaaaggagcagaggcagagtggcttggggcattacaatgatccgtgcagttagatgtgctcggtgttgatgctagacgtgctcctcccattgatgatagtggcaacaacagtactgatccctttaacattattgaggtctattatgtgccaggtattgtgctaaaaacacctagtctttatggaagtcttgtgatgtaggctctattcttactcccattgtacagatgaagaagatgaggcataacaatttgtgcaagcccacacagttaatgtgccggagtcaggctttgaactccgacagtctgactccagaccacctcttcctcccagtatccatgctctggtgcctcctgtggcacactcagaagatggcctgcatgtgcatgtgctcatttctgtgtgtgtgcatgcatgcatgtttatgcaggactgggaatgcaggggagttagagtccagttaggaaggagagaggaaatatgatctctttgttgcatgtgggcaccgtaactccagccaggcaaagtgctggtctgttgtagctcatttttatgtttttatttagaagcttcaataccagagctgatggcagaaaatgtgcagtaaaatgcggggaggccgctgggtaatggcccctgtaaagtgttaattgcctattgagactgcagactttgtccatgctccaggatctgaactattgacaggttctaatttatttcgggcccacaaagcgggctcctcctctaaacaggcttccaatcagtcacgcttccctgggcctgccaagaagctccagtcgataagtatgtttgctgccttaaccctttgaagctggtcgtgtggtctgattctggcttgccttaaggaaacttccatgcacaatggtcttggatgaaaatccatgagaatcaagtgctgactccgtgctgggctcccagctgggtgttttacatgcattgtctctgatccttaccgcttagagaagcaggtagtatctcttcaaggacatcctaacctcagagaagttgaattaattgtttaagtgaccactatgattatacttcagactgttacgggctaaactgtgttccctcaaattcatgctttgaagctctagctctcagtaccttggaatgtgaccgtatttgaatatagggccattaaagaggtgattcagctacaacgaggtcttagggtgggccctgatctaatcttactggtgttctttcaagaagaggaaatttggacacagataaatacagaggggtgacccactggaagacacagggagaaggcagccatctacagactaaggggagaggcctcagaagaaaccaatcctgctgacaccttaatctcaaactgcaagcctccagaattataaggaaatgaattcctgttgcttaagccacccagtctgaggtattttgttatggtagcccgagcaggtgactacacacacccaggacttggtgtggccttgaatttatgcacatgaccactgtaagtatgaaaactctgttctctggcttatggctccagttagaataagaagcagaaagtgggcaatattacctctttgcagtaaatttgttcttaggttgggtcctcaaagggcccatgcctatccattagaaagaaaaagaaagctagatttgggattctaagtgcaaaaagaagtcattgactgtttctaagcagagtcagtaacacaatcagaatttctttctttttttggaaaaaatagtctcctctggctactgtgcatagagaatggatggtagaacacaaaagtgaagcaaggagaccccagaggaggctgttgcactgcaggcaagagatgaaagtgacttgatggagagtggtggcaacagagaaggaaagaggtgaatagatttgaaatagatttttgagatggaattgacagaacttgctgatggattgggggtggaggtgagagggagggagttgacaagtgatgatgctcttgtttctggcttgagcaacctcgtctttacaggagctatttatgaggagggaagacatgaagaggaatcgattgggtggcaggtgttcactttctttaagtgggctgtccactggaacataagctctgagagggcaaatttattgattgaaggttgtatgaatctatttattcctgtccccacatttcatgcacacatatggtttttatatgaaccagaaataatgtagtttcttttttctacatcagaagcagactatattttatgtcaagggtgacatctaattttgctagtctcactctgttgcccagcctggagtgcagtggtatgatgtggctcactgcctgccgcctgaaactcctgggctcacgagaacctcccacctcagcctcccaagtagctggaactacaggtgtgaactaccatacctggttaattaaaaaaaatttgtagagatgggtgtcactatgttgcccaggctgttcttgaactccttgcctcaaatgattctcccttcttggcctcccaaagctcttggattacaagtgtgtgccactgtgcccagccatcacttagcataatgtttcaaaggttcatcaacgtttatcatccactgatacatgttgtagcatgcataggtacttcattcctttttatggttgaataatatttcattgtatgaacagaccatattttgtttacccattcaccagtttttgaacatttgtgttgtttttaccttttggctattgtaaatagtgctgttatgaacatttgtgtaaaaatttttgtttggacacctgttttcaattctttgggggtatataactagcagtggaattattggatcatatggtaattctatattgaacttagtgaggaaccaatgtaaggcatattgatgataactgatatgttccattttggaaagaggaaatggaggcccaggatggtctcaactaccatctaaacatcctcaactctcagctctttaacttcggtccaaatcttctctgtggtctttagcccatgtatttaattcctggtggacatttctacctggatatctcatagtcacctcaaactcagagtgtctgaaaccaaacacaccaacttcttccgtttattcccataacagcttcatttcctgttttcatctcagtgaatgacaccaccgtccaatcagctagcagtgggacatcatcgttggcctgtcaagggatggtactatttactgtgtgaccgtgggcaagccatccatctctatactttagtttccttgtccagaaagttagaagataatcttactggggatgagtatgaggatcaagcgagatgactctctctctctcatctctacccccatcttagcaaagtgtctggcacacactgtgagctcaacactattaacatggaactgttttgggtaagatgtgttattatcctgtggagctggtgtttcacagaacagagttgagggaaatagtgaactgtagcaatcattttcaaatgtgttcttgcaactggcagcatcagcagtacctccgctctatggaatcagagtattgagggatagagcccaggaactggcacaattaaaaaatgccccaggtgattttgacactcagccaagtttggaagccactgaattcagctaattacattctactatcagtaaatacattagaaacattagtaatttcaatcaaacatgaatttcactgttttcctccccaaatctaataagagcatcaatctttgatctttcaaataggtctccgtttcttctcactattctgttgaacttgggcagccttttttatgtggtccccatcagagctgtcctttatcaagttgcattttgctctcaggactgacagcatctggacattaaattaaaaattacttagacatactattggtgataatgttgggcactttgtgactcacctcatactgtcgtccttaggaaaactgtggctagtccagaccaggcataggtcttcttgtggagggcatagatcagaaagcattagagatagaggaaggtgttagctagtgttctgtatacaaaggagcctgtaggacacagtgttaagcaaaatgatccagcttccttttcttcaggacttctcagagccttgaatatagtagtggacactgactatcctaaagtgcaaatgaactataactgcaagtagcccagtctggacaaggagggaggccttccaaaggacacagtttctaggtggttagttttggacatcctgatatatcttgtcaggggcagcagcaaagctttggggcagccttcctgaagatctgagctgaggaagggtcaacgtggagaagtgggtgtgaaggggggaaggttgttggacattgagatctatccattgatctattttgatcaatgtctgtcaatatccttatgtcctgactacctggttcaccctctggctctgaaaagaaccactttggtttctgatgttctggaggcccaccagaccctctaatgacctgagcactgggtctgtcttcctggcacccatcaccagtgtcacatatatgtcccagccacaccatccatcatgtcaaattgtatgtacaactgtcttctccattatgagctactgaaggcaggtcttgtgtctttttcttctgtcgcctcctagcatagcaccaggcacactagttgtgttgattagtgtttgtcagttccataaggccaccaggatgctctgttttgtaggaaaggaagagaggcagcaggaaagcaggcaaggcagcttatacactctcagggattggaaggaatcaggagagggctccaagcccctggggctgcacagcccatttctctgcagattgccaccactagagagcacagtgcacctaggaacagggtctgccgagtgtctggctctggcccagcccagctctgctcagccccccacccctcctggcaacactgcaatgggaagcaggatttggatgaggctcagccctgcctcagacactttgcaatcttaggcctaattaaaacaccacagatggtttgaaccccgcattaaaatttgatgaggaattgatcagccaagcaaacaggaaatttagctgtgagtgaaggtaatgtttgctcaaatgtgtaatgaggcccacggggaatatttgtggggacctccgtcatgtctggagtggctcctgctcttcaatttcattttccctatttgcctttcccctcaaaacatcccaagatgcttccagaggggaaaggcaacacagggaaagttttagtttcataagaatttcctttgaaaacccaaggaaatctaaaatcctcaactatgtactggaaaaatagcacaggaaagggccagacttgggtgggagtcctggctctgccatttggcagttggcatccttaggttgcaatatctaattttatgattagtcactgagtacctactatgtggcagccaggggttagatcctggggatagacggctgtgcagaactgtcttggttcctgcctccatgggtaaacagctgagtaagagaggctatgagtctcaattttcttatctgtaaagtgggaatatttgtatgttatcatagggggttgttggatgaattaaatgagaacgtgtatgcaaaacgcagagaacagggctggaatacatgtgtcaaatgaaggttcctccatgtccttcttccccataacctgcatctaaagtctatacaaggcttttcagctttccttctacttaatgtctctgaaagtgacctaatatgatattcactcacttatatgttcaccactggtgggtgtaactgaggccaaggacacagcaagtcacaagactaacctatttaccagattggaattggatcagaagttctcttagaaagagatgaaatagcaagcattcttgggtcatctgggatgagaggagtctgatttgagaacgttgctccgaggattagggagaaacatcagaagcttaacgtttcctttagacacatccgtgataccttaagtgggagaagagaggaatatggagagattttccttcctttcacacatccacgaagatactttaccctaatagtaatgatgtgtatgttgtgtgctcagctttcccttcctcttcatcatcccgactcccaacccaatgcccacccattgccattcctatccttatccccgattccatccccacacccatcctcatgcccacggttacccattcctattcttatccccactctcattcccacactcatcctaatgcccactgtcacctattcccattcctattcttatccccactcccattcccactcccatcctaatgcctactgtcatccattcctgttcctattcttatctcccattcccatggccatcccaatggctactgtcactcatttctgttcctattcttatccccacacccatcccaatgctacttatccatgaccatttctttactcacctctactcctccccatcaattttcttccctgttaccaacatcattaatattatcaccagaatctttatcacaaaatatccccgtcactggtttggtaggtgcaaccagatttgatttccctttcttctactcataggatcttacataagttgatcatgtttgttaaatttctaggataacccccttccttaattccaagatgcatgcttccctgtctcacatgttttaatgtctttgaattcagaaggtacctcacaaaaaaatgccaaaagacaatttctagccacaggtagaagaatgagctgtgacagtgttgttattgctttgacattgcaatagactgctgaagtttcaaagatgggagagcctgggtgaccaatttttatgtcctggagaaccaccactcagatatttacataaggtctaaggaaagcaatggctgatttccaagtgtccgagtttcattaatagggaatttcaaaacaagggaaaaaacaaaagcttgagtttaatcaaataggaaatgaggacaaaaccttggttttcttcaatatgtttcagatgatgatgttacttctaaagttcttaaaatacagagcttagaattaggaaaaacaacatggcaccctgatactaagggtaactgctctttgagcactgagtaattgagtaattttcaatgactttgctactatggattgaatatttttcacttataaaagtcagtgaaagtctgggaaagtatagatttatatacatttattttgtatcttgtcatctaatgagatataataaattcattagtttatcaaattcttgtattatgttttctaaatttacagtaataacatttgcaaatgatacctgttttgattctttattttcagtagttaaccacttatttctgcctcctactttataggccagagcttccatcagaatcagtgtattcagatttcctaatattatttaattaattttggtcattataacattgtgatttttctaggaaattacaggtttttttttaaatcaagaccattggtatatagctgtgcagtattttctgtattaattaaaaatttccctcatatttactttcatatccctttatccatttttaaatttatgtaacccaaatgttacagtctcatgaggtcagagtctcattaagaaaaaatcctgcattttgaaggttctgagtttccatctgactgggtccatgtatcagtcctccttatttcttgccgctaacatcatgcaggtgtaagttctattaattttataatcccacttcttaagggtaaccacaacaaacattttggagtagaaaacatcagtcctttttctatacatacacaatatgtgtaaatataatttcatttcttacacagtggggtcatattatatattgttctgtaacctgttttttaatgtatcccaaaatatgttctttattgacttcataatattccacaatatgggtgaaccatatgctatttactaatttctttgttgtttcctagtcaggttgatccatttgtttgccaccgtaagtcatattatgatgaacacatttgtgaataaatatttgttcacatttctaattatttccttaggataaaattgttaagtaggcatgaataatttttcagcatccttgatacagattgccaaattaccctttaggaatttgtactaatttatactcccacttgcaatcgatgagtgcctagattgctcaactgtcaccaacattgagtttctttaatctttgcaaatttaatagattacaaatgaaatcacattgctgtcttaattagcatttatttgattattagtaggatgaaccttttaaatctttgtaatttatggttcttctcctccttttttgagacagggtctggctgtgttgtccaggctggagtgcagtagctattcacaggtgtaatcatagcgtactgcagccttgaactcctgggcccaagtgatcctcccacctcagcttcccaagtagctgggattataggtgcatgccactgctcctggttatcattcctcttacatgaactttctctgtctgtccgtggatcatgtttccctaactcagcgtttgttttcttactgcttttaagagtgatctaacccgtaaccttaaggatattaactcttcatcatacatgttggaattttttttttctcagtatgttgttgaatttttaatttttatagttaggtttatcaatattttttgaaatttatttcttcgcttctattcttagtgaattctgtgattagatcaatattgatttcagttttctcccagaggctgagctgagtttttggtgggtttggcacagagctccttaccctaacctcaatagcagaacaggcctcctttattgggagagggaatcctctttgaatgagactgcagctttgggaaggaggaaaatggagcagctatgaaagatggtttgctgtccagctcataaagtcatctggctcagcctggtgatcttggggtggcatgcatcacattctcagccccgtctgtctgagcttctgtttccttctttcatgtaaatcattaatctaagatttagttcagtgcatatttgagatgaggctctaacaacatatacaatatacaacaatatatatcaacaacaatatgtattattaaatacatatatgtcatctccctgaagccctacaagagcctaatgagatagatggtgatataatttatagaataggaaactgaagttcaggggggccaggcattttactcaagaactctgcctttgacattgacccaaatactctgccttggttagtccactggatgcagttgcagtaaagagctgggaagctccaaatcccacctacttgattgtggaaaggtcagtctcttccatgcttctgctttccaaatggcttgggggatttctagagaagcttccatgtgttcataaatcagtcctgttgtcattctctccttttccagataaacctgggatgactacgccacaccctgacattacagcatcttgttttatctccctgagagtgctaccagcaatgccacctccaagtgtagctgtttcaggtgtggaccctaacactggattcgtgtacccagctctgatgctgtcatccctcttgtggagtgagtaaaaggactttcctttgttatgggatgctggatgctgtatgctgtggttagttgcactgggactttgtaatttgaaggctctgttgcagctgtgtgttcctagtggtttcaaggtgcatctcctttaactatccaggcaataatggttccaagaggtgacaaggacaaagaacacttcctccttctgatttatgctcatttgatgaatgtctcattgcaaaaccgtccaggctccaaaaatattttccagttcttattcttagattttaaaactttttcagtggtctccctcccttcctacttcctacctcccttccgctctccctacttccttatccctccccgcccccacacagcttcccaccccaaatgctcatattgcaaatatgcaaataacaattaagattccgggttataaaaacagaaagaaacttcactgcatttaggtgaaaggaaatctgttggcaggatgttcgggatctcagaattgttaggcatcatggaccaggctagctaagagctctgtagatatatgaatcgggactcccagcaattgttttatggaaagaaggatctggttggggcccctgtgctatgcagcaatgaatggactctagccatttctttccacctcttcctttttctccctagattagaagtccccatggagagtgtaagccttctaaccttcctccacaagcctgcccctactcctgactgtactgggctagaaggaggaggatcatttctctttggtgtcccaaagttgaagtggtcacctctaataaccctcccaccaaagatatgcacaatgaagagaggcagttttcttagaggaaactaaagagaagtaataaacactgggtagcagctgctgcttccacttgccttggagagtctctaaaccactgacctcttaaatctttgctgagaagtggaacaaaaccatggtggggatccttggtggaaaatcatctattgcccaaccaattgggctggaaggggaagtttaggtcaagtggaaggctggaattagcctcatccatctacatggaggcagactcccttcatcccttaggcattcaaggctgtgttggcctctttatttttgtgtctcttccttctcagcgtttgttctccagatcatgattcctccctgccccctggctttattccagttcaccctagtctatcatacatttaaaaaaatatccttgaacctcaaggaggattagagttctgtttttattttataggagggtagggtcttagttcacatccttctgagaggaggagttggatgcaagctcatttgtttatctggaggatgatcccagaaaatggagaagtagggaaagaagaacaggggaggagaaaagccaaacaagccaaacaagtggcatgctggtgagtgtaagattatagctgtgggccacttggggtcaattctgctggggacccactgaaatagtgtgtggtatacactgtaaagtcttcccactggaggggggaggctgggacatctatccactgattcctctaccccatcatttggagattgcttctggggacatttgtgcttgcagcaggtcaacacactcaaggagtgatagataaagcccttaggcagagaagaaagacgtaggaagaggcattagaggtgggaagtgccagtgtcctggaaatgtttccatctgccactgcaggtaacccaggtgggccaaggggatattaggcaggatgtcaagagcatctgctacagagcaggctcttcatctactatgcaaattagtggattcatctctgcaagaggctaagtactgttacaagaaattgatggaagaccccaacgtcttatcagttttccacatccaatgggctctgtctactctaccttgtccctttttattactttgtgtcaaaattattgtcagaaattaaggtcataaataggtagcttaaaaagtttacgttcacatctattcctgggatcacacatatttcgtgtacttctcactcagttctttaatttctaccagattaatacattgccataaaagcagcttccaagtgcagtaataatcacaataatcactgtaaaatgtaatagataattatattgatgaagaattatatttagccatatgccaatataagaatacttattgattcatgtctatcattgttatcttctctctagcctttaggctatagttacctgtcaggattagtagtgagaagtctttggatggatttggaaggtttgtctgagccctggcaatgggtagggtacagatgactaatgtgaatggtctctagttttgttctctctacaaatgagctatgggacctcaataggaactgcacaacttgctttggaaattgtctgacttgcactggtatttttggatgacagttttcccactgttgatatgcctttctctttaccagcctttgttgattagaaccatgcagcaagaaaactcatgcatcactggaatgctccagtagagagcattcagcattgtgggttggctaattggttgggcaatagttgattttccaccaagaatccctgccgtggttttgttccacttctcagcaaagatttaagaggtcagtagtttagagacttctccaaggcattgttactttgacaagatgtaccagggtaattgattagtttgcacttgatattgccataaataattacaacaaagctatccttatcaaaacaaatgaaccaagcagtatgtctgttttgctgaaccccatgttcaaagggattagaaagatttagaaattaaccaaatctgtctttgagacactgcccctgaatgagagacagagtattgattaacatcctggaggaaatgacattgtaaacagctctggtttaatgaaacatggtagggaagtagggtagcaagacagggctagaattctgaccctccacttacaaatatgcccttaggtaagatttttgcttggctttctgttaccccattgatgagataggataaaaatatgaatccttcaggagtatcataaacatgaagtgaaagaatgtatgagcaaacactttgtaaattcaataatggcatgtagatgttacatgctcttgctgttaaatacgatatatagcccacttctttctacccctttcctggtttctctctgaggcagagattctcagcctcagcactattgacatttggagctggataactctttgttgtagagagctgtcctgtgtattgtagaatgtttggcagcatccctggtctttacccactagattccagtaacagcctcctggtcatgaccactgaaaatatccctagatgttgtcatatgttcatgggggcaaaatagaccttgattgaggaccactgctctgagtgtagagaagttgatgaacatttcctggaaattctttggaccttgcctctttactaggggtggcatccctgtatgttaaaaatgctcacagtcattctttgcaaaaattaattccaggagccggggtggatatatcagctcagcctaagttccactgtggtaacaaacactgcccaaatctcagtggctatgtaaccctctcctaagaagagtcagcccaggtcacatagccaaatccaccctaagtgggatggaagacatagaatttttccctgcaaaagatagtgaatattttgaagaataatacaatctactaccaggagttagttggtagaacacaggtcctttgtagtctacagatattgccatttttctcacacattttcctggactgactttttccaggtaccagccagttacttcttccaggtactttaggccccagctaccagctggcaggggctcagtctccatgccttgggtctcttggacttctcttctgacctgaccaaagctccatgttggggtattaggcacatgtgcagctgatcatcaagggaccgctttgattctcctttgcttttgcacacatttatggctcatgtagaaacttctcagaaagagccttctaagggtttcaggcacagaggtggctaaatagatctgcaatctgtaaagatgttgcagcatgcttggttgaaaagtcaagcagtcagttagtcatttacttggagtgttaatataatgacagtcacttggttgagctgattttgtcacttaactgctggagactgtctactgcttaactaaccagcataaccttcctccctggtgacacagctggagtgtgtcagaaatcctatcacttcagtagtgggactatggaaatgaatcttatagtggggctgaaggtcacaatggatgacaacgaagggtttctaaacctggatgcataggctaaactggtctgttcgtgacatggtgttgcccagttattgaggcaaatgcaatcacattttaccatttataaaacactttcatatctacagtcttccctgaaagtgcttcttgctcttttatccacctggaaaactcctattcaccctttaagagccctcttagatgtagccttccctgatggcactctcctctccatcattatacagttgtttgctccatcctctgtgctgtcacaatagtatcctcctccttctggtctgtgaagttgccaggcaaaggagattgctctgctggtccttgtatcccaggaactcaccattgctcctggcgttggaaatacatgcaggaacatggctggtttactagacagtttacccaaatttttaccatgactctgtacgccattaaaaaaagagagatttagaaagatttactcacctgcctcaagtctcacagctgccaattaactctttgttgtagagagctgtctggtggttggtggaatttagcagtctcaggacacttggcttcccttttgttttccagtaaaatttgagtcttctgggcactgattttagattggtacaagagacagtgattggatgcagttttagctgttctaaagaactgagtgatataactttgtggcccagggcttactttattatgtcagaaagacgtgagtttgaatcccagcccctccacttactagctgtgtggctttaggtgagttacttaacctttctgtgtctcagtttcttcatttctaaaattggaatcacaataatgcctatctaatgagattatttttaaggattacatgaaatagcatatttaagtggttttagcatttttgccggttatgtagtacacactgaataattcctagtttttaatactgtttttatttctatttctcaaacagtatattctgttttatgttgatgtattggatccttccttctttcctttggtaaactttgttgcatgtcttctttgccatgtattgatgtcagaaagaatccttaaaatgacaatacccaattgcatgattaataccacttcttgagtgcttggttcatttgagcccaacatccattgatcaaaatcaataatcaatgacaggcattatttcatttaatcttcatcacaacgttattaggtagacctcatttcttcccattatatggaggagaatactgagactcagagtaattagctgagggtttaagggaagaatggattgaagctgggtgtgctcagacacctgcggagggagcagaggagtccagcagtgtgttgagccttggtcctgtcctggccctgtggtctgtaagaaggaagaaagccacctccatgggtgccagtagctgctttcttgacactttttttgctgctgaaggaaaagtaccagatactctccccagctgactctccagggtcagtggagattcttgagggtcagtggaccaaaacggacctccagggtcagggtcattattgagggtccgtggaccaaggtcaagaggccttgggagttgttctgcagggtgtggcatggttcctgcccaccagttcccttctgggaaaggagagggcaattctgaggaacaaagaagttcagaagccaccagagggagcagaatcctgttctgcctccttgatctaccagagaactgatcactaattaacaaagcccagcatcagattctcttcacgctgccaaagcacaagcaaaaacttaaaaattccctctgtcatccacatgggactgtccaatacataaataaggcagagactcgttttgagtgtctgcgatgtgcaccttcctgacccaattccatgaattctctcaataacgctaaaaggtgggaaatagtcatgtccccactgcacagattcaacagtatattcattcatgcatcaagcatgttttcagtgattctatgtgccagacatgtgctgggcactggaatacaaaggtgaacaagacagctggggcttggggcttagagaggtgaggtcacttgccaagtcacagagctaagtaagcagtggagctgggatgtgtccatcccctgcagagtctgagcgcccacctgttatgcagaagtagtagtctggctgagatccctgggctttcttcacctcagtttccacatgcagataccagcagtaagtcatatgtggtatgcttgccttcagcacacatttcctcagtggccacctgggcacagaccctacccagaaggagtttatgctctagcaaaagaggcgggcatgtacagagttggtcagccatgtgccaaggcagattgtgataaaatcaagagctgagaatagagtattaactctcactggggtacatgtctttagaggccaagtgacaagcctgaggcttctggtgaggtttgggcaggctgatgacctgaattcagcttttctagcgcgggtggaggtatttctgtttcttggttttgcaaatacgaaaagaccactgggtgtctataatttccacttgtttcaagagaggtcactgcatacctgattttaaaaatgccttctgagtttctgccagtgcgagtgaatgctcagctggtaaacagccccaatgctggatgagggcatagagtcccctgggtcctgctgtgcaggccatggtcaggattacaaacagaagcccttcattaccaggcatatcttagcttgtcctgtatagtcttctttctctggtgagtcacttaaactagcacttttcatacttcactgtgcataaatcacctgggatcttgttaaaatgcagattctgatccagtcagtttgggacggagcctgctaacaagctctcaagtgatatgatgccgattgttcatggaccacactttgcgttgcaaggatgtaggccagtatctccaaactggtttacatagaactttagtgttcagtaaggtgtttgttttgccatgttaaataagtttgggaaatattaggttaaacaaagttaaatgagcttttgcactgcaggacttctcagaacttttaacatgttactgtgcacctgtctctccaagacttggattgagtatacagtttcccagattttaccaggaaaacccccattcttgcccaagtccctcccaagagtagccatttagttgtgtgttttggaacacagctcagacatcactgctctggactttctcattctggaagctttttgctctccacgccaatgtattttcttccatgcttcatcttcctccagtctctgcatatgtttcctttcttagcctggagataattcattaaagcagctctcccactccctgcctccctcttcagatacacctttccacctcctaacaccgtgactaaaaaacaccatcaatatttcataaactcacagtgacaaatttattttaatgtggtccaccgagagccagagattgattggtccctcagaagcgtgacacgtttcaaagcaggatattcatggtgtgttttagtgcctacattagtcagagaggagcggagcccggatttatcatcgttatgactttcttggtatctattctcttctagccactggcagcaactctctgaatgctccctattgattggttttgtgtctttaaaatgtgctggctggggaggagaggggggacttgggtctctatgaaattgagcctagcttgctggagtttctgcatattgggagcttgtgtttgggtgaagccaactctaattctcttggttttcactcatgagggcattggaaaaaggggctaatctccttgatttctggagagtattagtgattggaaaatgggacaaatgtgtacggggactgttttgccagctgtcactttgcaagcctgccccactggctgagcaggtcatagtaagtccttgacatccgggtcctgaggcttgacagtctgatgaggttttattttgttgttgttgttgtttcccccctccccctacccccaacctttcaggacaggtacagagtagggtcaaaattgttcttaaatttagaaaatctcttcctctcacagattaaataataatgataatggcaagtgacctttattgagcacttacaatgtgcccagtacagtgggacatgcattacagacataatttcttttcataataatcctaggaggaagaaattattatttccattttacagatgagaaaactgagggttagagagttaagtggctggcccaaagccctgcagctggtatgtggtttagtgaaaactaaagcccaggtcgagccaactttacatgctagctcttaatccataggcctgactgcctaagtgaagcagcccagagaacctgctgttgcctaactgataagctataattaatatgttcttacttattcatccttactgattcagaaggtaaggtctttcttcagcaatactcttgggctaatttgagtttctatctgactttctaagttaaataagctattgctctttttctttttctttttatttatttatttatttttttgagacagagtctcactctgttgcccaggctggagtgaagtggcacgatcttggctcactgcaagctctgcctcccgggttcgcaccattctccctcctcagcctcccgagtagctgggactacaggaacctgccaccatgcctggctaattttgttttcgtatttttagtagagatggagtttcaccgtattagccagagtggtcttggtctcctgacccttgtgatcctcccgccttggcttcccaaagtgttgggattacaggcatgagccactgcgtccggctgctattgctcttttaaattaccccagtttctcattaattgagatctcctcaaattaatatgaactaatgagaccctatcatattgccacatcactaaaagttgcatttagtcatatgtggcatgcttgtcttcagcacacatttcctcagtgcccacctgggcacaagccctacccagacagagtttatgctctagcaaaagagacaggcatgtacacagctggccagccacacaccaaggcagattgggataagactgaggggcactgtgtaattggagagctaaggaaagagcagttaactctcactgggataaatctgggaatatcttattgtgaaatatcaattgtgtggcgcctggaaaagatgaaaaaagatttaaagaagcagagagggttctgaggatgctcctccagggaagtgtcataaacagagatgcagcggaagggggaaacatgttgtgtatgttagggacatatgactcagatgactagaaaatttagacaccctttgagttcatccttccttgtatggataaacatgataacacactttctcccctcatatggataaggatgcattaagcaaaatgactgtgaaacaaatcctagttccacttggcctccattaggaagtcaaagatatatatctgggagggagaaaaaaaatcctccagcagattgaactgaagcatattgagcagttgaggcagcaagcagttaatcctggtgactgtagacagcagccatctctgtgcagtggggtgcgtgggcctctgcttagcagtcaccttcccactgaatcattttgaaggggttttgccaactctagggtttcccctgaaatgaagaccatccccttgctctagacaacagaatttctttcatacttaggcaacttttgacttcttattttcgggatccagaatttagctgcttctttttgccaggacataacagaaacacattgagagagtcggctcactagggctctgaattcctacgattgtttttcattctttctgtttcggagaagggaatgaagattagggataccagctcctgtcttggagttactgtaaaatccagtcataaccatttctaggagagtttctcggtggtctgcagatgacctgcatcatacacaccaggggtatcatatgagtaaaaattcccagcttaagacctgggtgtggggcccagaaatctgtattaaacaaaaaccaaacaccaacaaactaatcagaggtcttaatggtcagagatgcaatgtgtggttgggtaggtttgccctgtataccactgagggctccatttacataatacataggcagcccctagatttgtgcagtgcaaaacctgtgcaacagctcatggcagctttgcattgcagaatcaccgtggtgagatattctggcattggcatgtatcaagtccaaatgttagcacttttttctgatttattctgcctcaccatctactgggcatgtcagagatccctggggcccagggtagagcagctacagaggccttatacaaacctcattctttaaaggaagaccccaccagagtgttcatctgtagtaaattgtcaggtagattggggaattttggaaagattcttcatcaccaaataaaatgtgtttgcttcttttttgttatttatttatttattgagacaaagtctctctctgttgcccaggctggagtgcagtggcgggatctcagctcactgcaacctccacctcctgggttcaagcgattcgtactgctggacttgatgcttgaattcagcagctcatggaggatttgcaccctattttctgtctgtgaagctgctaataggcccaggattcctcaagaccacgttcggaaatgctgccccatcatcccctgataaagttgacaaagctcagccagaagcaattctgatgcagaggagagtacacaggacgagaagaccagtgtttggatcatgacccatcagttactggctatgatatcttggatacattattaaaactctttggaccttggttttgccatccgtgaaatggggacaagcattctcacctcctgggcagatggagagaatgcagtgtgctaacaaatgaagagtgactatcacagtaaatagtatttccttcctttattcaagcatgtgagggactaaaatgtatcaggcatgtgctaaacatggggaaaataatggcaaatgaattcacagagctgctattgttagatcacagggttgattggaaagactgaaagtgaagaagtcaacacataaatatagtccagagagaaatatgtcccaggcagaaaattagggctgctttaaaatggattatcagggaaagcttctgggaggaggtagcatttgatctgagacctgaatgatgacagtatgtgaagaagacagacaggcaaagagcaggggatgagcatttcagatggagggcacagcttgtgtgaaggccctgaggcaagggctagtatgatgccctggagaaacggaaagactgctgctgtggctggaatacagaatgagagaagactagagaagactgacatggaacggagcatggggatcaggcaaggggtttagttggaagtagttcttagtgtagttggaagtaggttcagaggtaatgctacttttccttttcccttctgtggactcagctgcttgattcatgccttatatcaattaagaatgtttgtagcagccgggagtggtggctcatgcctgtaatcccagcactttgggaggctgaagtgagcagatcatgaggtcaggaaatcgagaccatcctagccaacatggtgaaaccctgtctctactaaaatacgaaaattagccgggcgtggttggttgcagtgagcagaaatcacgccactacactccagcctggcaacagagcaagactccgtctaaaaaaaaaaaaaaaagaaaaatttttttttgtagctacaagtaacaggaaatgtaacaaagttgtcttaaataagcaaggatgtgttcttctcacataacaatatgtctagaggtatgaagatgctggtcctggttcagcagctcaacaatgtcacatctctgggctggcctccctgtgattctcttggcgttgccctcatggtcacaaaatagctgtcatagcttcaatcatcacatccttacaccatggtcaggggcaggaagcaggagccagtgtgggagcagacagtttctcttcaagtgcctctttttcataaggtcagagaaaactttcctttagcagatctctttgagtcatattagagtggaatgatatcctggggtccaagcatctccacctgatgaagaatgggtggagttttactggcaagaaaaaagtgcagggctggtaatcacagtgatctccaaattccccatgttttcacctagctccctgagtgaaggctacagaattttaagttttgcctccaactaggaacagcagccctcagagcaaatttcagtcttcttggaagctcctataagacttcttatttttctctggcaccacacaggccacttgtccctcttgctctttagcaagttgaaggcacaggatttaattaaaagcaaaacttgacataagtgtttttaattgtaatagaaaaaagctgcctgttttataaaggtgacagtttgcaaacacaaatgtgaacatattcctacctcacttggcggcggccccgtcagagagtggcagagtggtacaaggagatggatctggtgtgaatgacttgttcctgcagtgaaggatgcaacctgaattcctcctgaggagtgccagcaacacctgtcatcaggtccacttagctaatgagatccaaggggtagcctctggtaccaccgtttctctccagccttcagacttgcctggaagaaaggtgcagttccctctcatattggagaactgggacatccatgacacactgcagaagccagactgtctttcactcaggcctgagttcagtggtgatgcaaatcgttcattctgtccccaggatgctttccaacattcatgtttttaaaggtcaatctgggccgggcaaggtggctcatgcctgtaatcccggcactttggaaggccgaggcgggcagatcacctgaggtcaggagttcaagaccagactggccaacatggtgaaaccctgtctctacaaaaatacaaaaattagccgggcatgatggcgggcgcctgtaatcccagctacttgggaggctgaggcaggagaatcgcttgaacctgggaggcagaggttgcaatgagacgagattgtgccactgcactctagcctgggcgacagagcgagactccatctcaaaaaaataaaataaaggccaatctgctggctggggagctgtatttgcattcttctcctggatgttgggtcagtgtagattcagctgtggtgtactcatggaggccactgcatcttctgggtagaagactgagtctctttcaatctcgttttgcagagagatgtctggagtgtagaaacctaggaaacattcagctgcagagaatagaaagtgactcagataagtccagacagaaagaggatttactgaagacatctgagtctctcgaaaaaaatcatatgcaggagccatacgtgggcttttcttgcatctctgctgtatctccctttctagagatctgattgctttgcaagcctcccaaattctcagccttgtggacttctttctcagttttctgtgttgattctagcctagcctccatctgaccttgctattcaactgctcgttcatttattaattcaatgattcattaatttatcaaataatcacagaattatgtgtataatcacaaatggagacacctcctgcaaaggaaaggattatggtgttctacagccaaatgcttcagtttttgtgtctcagttcccaccattctgggtggagaatatgattggcccagcctgcaacacctggtccaatcagcaatggccaaggggtgatgaggtcgcacagggccaggcctgtgaatggagcatattgtctaagcctgggtatggggtgggaggaaacgcttgaaatctcttttacaggaagagcttcagatgagatatccacagagttaccttggatggaatctgatccacttcaggcttagttctcagaaaagcatcactaattatacggacgaacaggctcaggggtttgcattctagatgtttggtttgattctgactggctgcaaatgaccagcctaactcactggatggagcattctgcgttccaagtgccaggtgtgggcaggtgtccagctgcagatgggcctctgctgacatccaggccacaggctgagtggctgtactgaagggaacaccaagcctttgattccataaggtccctccttcactgaaatgagatgatggcacaggtacctcaggatggaaggcagtaataagcactgaaacccagctgtacagctttcccaacatttcatgctaaagctttgagtataaactgagcagcatgacgagaacaggtgtgaaggaatctttcatctgctcattcaccaggctttgatggaggatggaccatggctgacccagtcccaggcatggagagtcttgaggagttcatgatgacagccttccccatcccacagtgtttccctccttgaaggagttaagtaatggtgtgaggcagccccagagtctaggcccacagcagtggagtcacgtgctccttgcattccaggactggctgcctgaggctgggacttgcaggaaggctgtatacagagagctcagggcaatcattcagggttctgagggtcatgggaggcctggccaggggtggggggtccatcgctagcagcccacgcctgactcttcactttactccacccacttctgttctctgcagccaaggagaggcggacttccttgttctgcctggttttccccacgtgctaccagctaataggctgcagctgtatttcagaagagttgccacaaggaaaacttagcctgtaagtcaagcactttagttctccaggcgtgaaaaacaacactctttatttctggccatgcctggctttgtgagctgtgtctaatggcctcataaggagatataccaccgcactgtcagagtggtcctgggatttctgttagcaggtgaccctctgtccacaggtatggaaagggctggagttggagtcttggcctgtgatatgtttgccttgaaataaatgtcttaaaaaatctgttcaacattaaacaaaacaaaaggaaaaacaggaaacaaaaacaaaaccaaaaatcattactggatttttgggagcatgaaaagaaactgcgtgaaaagaaacttcgtgaaaagaatttacacagtgcttggcccctattgagggctcaatcaatattagttgttattcctattgtaattacattaattttgctaaacatttcaggcacaatgtcactgttcttcccagcccatgtcagtctaaatctctattgctggcatttgccctggtctgttttgttgttgtctcatgtagtagcccaggaatcctctgggattggagacccccatctgtacccgcctccttgtccgtatttggggcttgcttccacaggcagaatctgggatctgtaccaccatagagaagctttgaatatcaccaaaggtaaagtcttgcctggctggtgctcagctgcctggttagcctcagctgaagttctaactcttctaggaagcatccccgaaaagtatcctcctttctgcttcaatccacttttaaaaagcccctgtgtatggaatattgtatttgccaaagtgggcagcaataatatttcccattccatatgcttttttacaatgtgactttgtcactttttccagtgagtggtagtgtcatctcttcttgagtcttagtgaatctttggctaacagactagtgtagattgatgctgtgtggcttcggaggctgtgccattgaaatgccacgcagcttccaccttgctctcttgggatgcttactctgggaaccagccaccatactgagagtgagcccaaattaactcatcttgagagaccacatggagaagtaacgtgcactgttccagctgactgtccagctggggtccaaactgacagtcagcatcaactgccaatcatgtgaatgcagtacttccataccagggtcagcaaacatttttgtaaatggctggatagcaaatatttttggctttgcaggccgtacagtttctcttgcaactatttgactctgctgtcatagggcaaaaatagctatagacaatatataaacagatgggcatggctggattcggctcacaaactgtagtttgcatcccatgctctaaatgactccaaacccagccattgagtcactgtcatcctcccagccttccctgttgagcttctgcctgaatttctcatggacagatgccatgagttgctttctgctgtgacgttttgaggtggtttgaatgtagcaatagcacctggatccctccatatctctgttttatgattatcagttttatgattcctatgcctatccttctagttctgagcttcccaaaggtaggtactggctcttcctcctctgcctcctcttcagcagatctagtactagagtggcaggtgtcatgtcatgcactttacatggattgccatctttagtcttcccaactattattacatctctattttacaaataaacacagtgaatctctgggaggtcagtgaattgccccaagtgactcagaaacacacactcctcaattccagggcccaggattttatccacgataccatctagcctcaatgttcatggcataaaataaaggtgtgggagcctgagaaacacccacccactcgattgaaaacaaaatctgagtccagaggccacacatgttcaatcccagctccactctccatgccttgcagagttcctgggcacaggggattggtatagtttggatgtttgtcccctccaaatttcatgttgagatgtaatcctcagtgtaagaggtgaggtctggtggggggtgtttgggtcatgcaggcagatccctcatggcttagtgctgttcctgcaaactgatctggttgtttaaagtgtgtggcacatccccttgatctctgttgcccctgttttcaccaagtgagtcacctgcccctcttctgtcttctgtcataagtaaaagctccctgaggcctcaccagaagccaagtaaatgctggtgccatgcttcctgtgcagcctgcagaaccgtgagccaattaaaccacttttcttcataaattactctgtatcaagtgtcagatttttctttacagcaatgcaagaatgacaacacagggttgtacagtaaattttggttgggtgagcaaataagtgagtgactagtgcacatcacattaggttccccatttggttaatgtcagggtcaggtggactaatgttggagcacattcccgggtagaccatttacttcagtgaataagccttgtgcagatatggttggcagcctgtctgtatcccctctgcctactccagcaggtgcctgcagacagttccataaatgccagtggctgtttccctctgcctcagtgcatgcatagcccaagggagtggctcagcttgcaagtagaactggtcagaagggtgggataacaatcccaggatcagccatcaaccaatgagggatgggagttggtgggtaagtacccccgcttttcacccttccaaagcacaactctgaggtgtgctcacaggagtctcacagaggagccctttgggatggaggtgcattgctctttaacctcttaacaagttacctttcttctgttctcatctcaatttccaaaccctcacactactttctgaaagcacctcccaaagaaataacttgtagccaaatcttagtcttcagatttgtttaaaagcaaacctaaagggtttccctaagctagaacagatgtgtattgtacatggtgtaaaacctggtgcacattctagtacacatgtgtacacgacacatctgcatcaaagtctgagttaggccgggcgcggtggctcacgcctgtaatcccagcactttgggaggccaaggtgggtggatcacgaggtcaggagattgagaccatcctggcgaacactgtgaaaccctgtctctactaaaaatacaaaaaaattagctaggcatggtggtgggcgcctgtagtcccagctacttgggaggctgaggcaggagaatggcatgaatctggggggcagagcttgcagtgagcagagatagtgccactgcactccagcctgggcaacagagcgagactccatctcaaaaaaaaaaaaaaaaaaattctaagttagtgcaaagacataattattggttatattttcacggatgtggttttcttgcctttgagtatatatagtaactggaattaggctaagatttgtttattattctaatcaatagatacgaatgatttgtaatcaaatcaattgcatttaagtaattggtgctcagaaatacttgagggagattcagaatggtgctgtcttgggtggttttaatcatcttacccctgaatcttgctgtcaccataactttctatcaaacctcttcttcatgaatcgaagatgtgctggagtccaggcccagcctagctctgtcgcctccacactggccaaggtgtaggagggacacatttcagattatttggagttagtgggggcatctggactagcatatggggactccaagtgttgtcctgggaattctattggaaaattatttttggacactctttgtagcttaagctgtgtgtgcatccctccagagaattactgacaggtgtctgggggcactaccaatgtgggtcactgagcactaaaagtgtgtttattttggaccactgggagatttactttgagctgcatattcactggagggctggcttttggttactacttttctaggacgtcccccccacttctgatgtgctgagcgctgagcaactgttaattcagatcttctggggatggtggggggttggcggaagagtttacttcacagcttcatatagagcatagacctttggggtcttggtgagattgaggagggtcttctaataaactctcaagcttgagttgacttcgacgttgtcttctctttcccacattctatgaggttgtgaacattgaagctcaaattgtccagatttggcaaatactgtctggacaaaagtctcttcggcattccatatctctctggggttcagcctttacttctactttgtactgataactcctttcagctctttcatgattttaggaagatttacaaaatacatttgacccattttttaaaaagttactttcatcagggaggctaattccaatacctaatccaccatattacaggagacaagtttctgtcccaaggatttaacaaggagcctctctcagttgaacactgagcaggaaccatgagttggagaggattctggagtgtgaggacaggacttttaaaaaccttagctcaccattgcagctttggacattagtctgctggtggccccatttatatagatcaaccagtcagggaattaaatactcttgtcttatgaaccaatgggaactggaacaagtttgatctgtcttattacagagggctgaagtcctgatttggtaaaagtattctgtgattgggaacctagttatacccaactcatccatccatccatccatccacccacccacccacgcacccacccaataaatagggacatagtggaatcccattctgagagaaactcagagaggaaggtgaaaacagacagcacacatgttttaacaagccttccctgaaggatttaaggtattcatatgccccatttgcaaactccttcctgagccaagtgttggatccaacaccctgtcatcatgaacaaattcctgataaaatacatcttgtataaaaatgagaatgagagacaagtctttgtgagaagagtagatagatgtttaaattaagattaagattttttgactggtagttaccaccccagtctttagtctaattctggccactgctaattttataggattacaatgggaaaagacactttcttcccctcttgtgtttcatattgttttccactgaagaaagggaaatattagaaaaatgcctttcaggaacgaggtcctatattagagcaataaaagctaaaaccctagatctcaatggtgcaatgcaaaaaacgttcattttccatttattccaagtccagtgattgtgctcctgttctgtggctttcctgaaaagctttccttcacgtgtgactcagggactaaagatattgctattttgggatgctaccacattaactctgtcaaccaacttaaactaattgacatctataaaacaacaacagcagaaatcacactctttccgagtgcacatggagcatttaccaagataggccatattctgggccataaaacaaacctattagttttgataaatttgaaaggattcaagtcataaatagaattttctctgactacaattaaattagaaatcaataagaaaaaagatacctgaaaaatcctcaaatatttggaaatgaaataccacacttctaaattagccatgggtaaaagcaggaagtaaaacatttttaacaaaaaaaaatatggaatttatgtgataaagctaaagcaatacttagagggaaattgatagtgttacatgcctatgttgcaaaacaagaaaacgttcacatcaatgacttcagtttccaccttaaaaattagaaaagaaggatcaaatttaacccaaagtaaacagataaaagcgaataataaaattcagagtgaaggccaggcatggtgactcacgcctgtaatcccagcactttgggaggccgaggcaggaagataacctgaggtcaggagttcgagaccagcctggacaacatggtgaaaccccgtctctactaaaaatacaaaaattagccaggcatgtggcaggcatctgtaatcccagctactcgggagactgaggcaggagaattgcttgaacctgggaggtggaggttgcagggagccaaggtcgtgccattgcattccagcgtaggtgacagagtgagactctgtctcaaaaaaagaaaaaaattcagagtgaaatcaatgaaatagaaaaccaaaaaaagagaaaaatcaatgaaatctgaatagacctatgtctgttaaagaaattgaatttgcaattaaaaactttcccataaagaaaacttcaggcccatggtatcactggtaaattttatcaaacatttaaggaagacataataccaaacatacacaaactcttacagaacatgaaagagacttgactatttcccacaagatgtctgctctcatcacttctattcaacgttgtactgggtgttctggccggttaaactaagcaagaaggaataaaaggcatctggattgagaaggaggaagtaaaactatctttactcacagatgacaagattgtctctatagagaatcccatggagactacaaaactattagaactaacaagtgagtttagtaaggttgcaagagacaagattcatgtatgaaaatcaattatttctatatattagtaatgaataattgcatattggaattaaaaagcaataccatatactagagaataatatgataaaatgtttatggataaatctaataaaagacatgaacaatctataccctggaaactacgaaatatcactgagcaaaataaaagacaacctaaatagagtgctatgtcttgctcatgggtctgaatcagtattaagaagtcatttctctccaaaatggcatatgaatttaatataattccaagcaaatggacacactaattctaaaattcatttggaaatgctaagaacctggcatattcaaaataactgtgaaaagaagaaaaaagcttgaagtcttatgctacctgatttcaagatttgttgtaaagttacattaatcaaactgtaagttttgtcatcaaaatagacaaatagatgaaggtaacagaattagagagtccagaaatatataacagaatagaattccgcatatataggggcagctgattttcaataaagtgcaaaagacaattcaatgaggacagggtagccttttaaacaaatagtgcttgaagcatttggatatccatatgcaaaaatatctaaactttgatctgtaccttctaccatatataaaaatttaaaaaaatggatcatggatccaaatataaaacataaactataaactatgaatatatacatataagtataaatccaaatataaaacataaacctataaaacttctagaagagacaggagagaatctttgtgactttggattaggcaaagagttcttagataagacaacaaaagcataagtcaaagaagacatggaccaactgcctttcatcaacattaaaaacatttggtcttcaaaagatactgtcaagagagaacacaaagataagccacaggctgagaggaaagctttgtagaacaaatatccgctaaaggacttatatccagtatatttaaggagctcttaaaattttatattaagaatacaaagaccccccaaaaattgaacagaatatgtaaacagagactttatcaaaaaagataaatagatggtgaataggtacatgaaaagatgttcaacatcatgagccattagggaagtggaaattacagccataaagtgagatcactatacaccaattaaaatgttgaaaattaaaaagactgatcacaccaagtgttggtgaggatgtgatggaaaaaaaactcatatattgcagatgttaatgaaaatggtacaatcactttaaaaacagtttggcagtttcttaaagtgtcaagcatatatctactatataacttagctattccattcctagatatttgactaagaaaaaaggaaaacatatgtctacacaaagacttgtacacaaatgttcatagtagccttattcacagtagcctcaaattggaaatagtccaaatgtttgactacaggtgaatggataaattatgactctagtcataaaatgaaatactactcaacaataaaatgtaatgaattattgatacaggtaacatggataaatcttaaaataatcatactgggtgaaagaagtcagacaaaacagaatacctactgtataagttcatttatataaaactttagaaaatgcaaactaatctatagtgacaggaagcaaatcagtgattgtctaggatggggagggagagaaaggaggattataaaaggccataggaaaattgttgggatgatggatatgttcactatcttggttgtggtaatggtttcatgagtatacacataccaaattgcatactttaaatatgtgtggttgactgtatatgagttataccctaataaaggtgttaaaaataggctatctggctgcttggttgaaacagtttgtagatgacaaacatcaaagagaaggcctcttttggaagtccactgcaattagttcaggtgagagatgattggagcttgagctggggtgatagtagggaaggtggtgagtgaaggtgggattccagatatgttggagatgggctgtgagaggaaaaggtattgaggcttgggatgcagtttcctggcatggggatggctctgggagattaaataactttccctagtcatgctgcgaactagaggctattctgggattgaaatccagatctgccaagctccatggaagtcctgaagagcaagggctccctcccttctcactgtttgtgaaccctagggtgaggagagatggagtgtgggtacaggacctggctgagaaatatctggatgtggaaggttcctgcttgcctgaaatgcagggccctgtggtcctgatttaccccaagcttcctcagttcctgggggaaggtaagatgggccaaggtaggagagaagaaggacaaactggatgaaccaagtaggtgcctagaactcaaggcaaccttgacactgaagtgagggtcctaagagtgcagttccttaacaacttcaaaccctgctgaactcaccagaccctgagccttgagagtgtgactgagcacatggagggctgtgggtgtggtacataggagtggctgtattatgtagggtgaccaattcatcccagtgtgccagaactgcccaggttttggcactgaaagcttattccagggaaaatgtggacggttggtcatcctacctgtgtgcctgaatgaatgggcatggatgtgtgtgtgtgtgtgtgtgtgtgtgtgtgtggtgtgcatctgtgagttcttgggcctgtgcaagtgggtagagctaagtacatgaaggaggacgtgttaaggagtgtgtatccacgtgtaagggtgttactgggacttcgtagatgtctcaggcagatttatttatcccctctcctgactccttctgtgcttccagaaagaattagaggtggctctatgtgcaaaggcagtgttctgagtggtggagagtgtggactctggagtttgaatggacctggcttcacatcctgcctcaaccactactgcctctgtgaccttgagcaagcaacctaaccactttgtgggtcattttcctcagtgaacaatggacacaaggaccctttatcatggccacaaaagaaataatacatctagaaggatggccactcagtaatcgttcagttcattgtagtgattactgtcactgttcttgtgagtctggtgtgtgagactgagtgttgtcttatggagtgtgtgactgtgagtgtgtgcctgtgtgcatgtgcatgagtgtgcatgtgtgagtgcgtgcaattttgtgtgtgtatgtgtgcatacttgtgtgaatgtacgtgcatgtatggcagtacccatgcaggtgtatgtgagtgcatgcatgcacatgtgtgagtgtgtgtgtttctgctcatacagagccatccactctcagggtgagcaagctaccttgggcttggtcaggaagattgtgtggggtgggtagagaccagggtccctggagacgaggtgtctggaatctctgcgttctttttcatggtgccctcagctcccagcagggctctggccccagttctcagtgatgtgcgttggataggattgagttctgtattgtacaaactgccttattaaaatatatgttgtgcattcatgaatctttaatatgaggcacttagtgagtccataatctcctcaattgagctgtataaaggaggactgtgggggagatgaagactttctgcagaggctgcagtgaggaggggcagctgggggtggggacagaaggttctcacatatgagggtgggggacgaagggacagaaggttctagcatataaggggaggaggaggatgaggatgaaggagtgattcccccagaggaaggacagcagatcccacaaacagaggatggtggttcttgtggactgaaggaggcagtttccatacactgaggacagcttttctcccagatggaaggagaaaataggtggttcccatggactgagggaggatgaaggaagaaagtggttcccagagaccaagggaggtggtttctacagatggatggaggagagaggcacttctcatagacaaggcaggtggttctcacagcctgagggaagagggaggaaggaggtggttcccagaggcagaaggagtagggaggcagttttcacagagggaggagggagaaagaaaatggttccaagataccaagggaggtggttccttcagatgcaggaaggaagttctcacagatagaaggaagtggttcttacagacatagggaggcagttcccacaggatgtggggagtgggtggttaagatccaccaaggctgcagggtctgatctaggtattactcttgcaaagaggttgactatgtaaagggagaggacctatgtattttatggccatctggtcaggctggcaggaggaggtcagattgccctgggaggcttggtgcattatgggactagagtgacttttcttggagccaaaggcctgtccgtggcttcttttactcaagctgtacactgtctctgcttactggcctgcttgcatgctgcaggccctgctcagagaacctgccccactgccttgtctgcttagctgtagccattggaccaaggggcatctgctgatctgttgtcagacatctctcattgctgtgagatgcccatgcatagctcagaacttggcatacagactgttcattaaatatttgttggatgtgtgctggagtccccactgtacctagaagaaatggaagtgtggaaagattaagaaatttgcacaaagtcacttggctgttgtcagataaggagatcaatcacattctctcttaagaatataatttggagacataaaataggagttggtagacggcatttgagctaaaagttcatgcacagttggggctggagttggtgtcttgacaacctaatttatttgaattattgggtgacaggtgggggtgagtaggcaaaaaacgtacaatgaaagaaacccctctgaagaggagataaagctgactgcagagaaaagtggagatcaaaagacagagacagatgtagagaaagaggagaaaggtgcactcttccttccttcctgaatgggagcaggtttgaatgagttcaagaccctcccagggctgagcttctggcctgaatgccttgggcactcagtctttgctgaggcaggtacaggacagacattttctcactggattttcaccgtcgtcttgtactgtgtgtttcccattttatggttgggaaaactgaagctctgattggtgacaaatgcccaggggcacacaactgggaggacacagaggccagattgaaaactactcttttctagctcactgctctctagccacactggcctgggacaacccccagtcctgtctcggggtctttgcactttctgtccctctgcctgaaacactttatccttatgtccacgtaactggctctttctgaaccttgaggtctcagcttggtgttgcctgcttgagaaagttcccctggtcaccctgtctaaagcagccactacaagcttttattcagtaatagccctttggggttgctgttgctgttgtttattagttttggtctacacggcatttatcacaattggtaattattttattgattcaatgatttaacgattcacacacatcctgtaagctccatggagagaggcatggcctgtgtttttgctgtgagatgcccatgcatagctctgaacttgggcatacatattatgttcattaaaaatttgttggagtctccattttacctagaaggaacggaagtgtggaaggattaagaaatttgcccaaagtcactgagaaaacgaatagctggagcaggggttgaaccagcatctgatccagctccagagtccacactcttcttcgactgtcacactaggaaatttccatgtactcctcctttgtgaaaatcaccgtttctctgggctggaagatgtggcagaaaaggctgtctcccactggtctgggcagtgagcacactccacacccctgctgtttaccccctgtcctgagctgcagtggtcaggacgtcaaggttcaagactcagccctgtgctagcttgctgtgggaacttaggtgatcaattacctgtgcgtgtctcgtctcctgccagccatgtggctgaggccctgctgtgccctgtgctgaataaagacacagagagagagtcaggagtgtccaggagcagggtgggtgttgaagtgcctgctcagcttctgccatatttcattgtcatagctatcaaccttccttaatttcaaaggtgagtttgagcacctgggagtgaggggagagggatgccaagggtcaaaggcgaagcatggcagaagacaggtcactgctgccacaggcactcaatgtctctccctctgggagtgggctagggggatgtttatactcttgaaagcaagaaactaggcactggaggggctttaggaggtgaggagtggaaagagtctgctgccctggttcactgaggtggaagccaatagaagaggagggcacttggtgcctgggcatggaggggaactctgactatcctgtccctgctcccaagaccaagaagagcactggggccactcctgggcgctgactccctgcactctggctcagctatgtggaggaggcccctgggagaggggcctgggggggccaccaaagaggaggtggacgaaaagccatcctgctgtgtctccctgaagcagcacgagcacacgcaattataagacagtgggcagatgacagagttagttaatgtaacaagccctttaagcatttagccacattcgagtgtttaatcagctgtgtaaagtgcaatatctatctttcaattttatgccattaggggagacaagattttgattaggtacttaatctgtgcacggaaaaaacaggcccacagcaagcccacgatggggagggaaagggacattggacgggggattcgataaaggggaaagacagaaatttaacataaaagagaattagtgcagctcctttcaatttagtgcccaggctttatggcctaatcaattagaggcctggccaagcctgctgggaagctgctcggctgggctggaggctcggccatattaattcctttcattacgcgggggtcaggctgagggctttgggggggctcggcaaggagtgggtcacttctcgggcactggctctagaagccaggggaggaggtcaaatggtgtcatgctggacaggaagtgtcctgggggctcaaggagggctgggtacccagtagggtgggactgagagggttctgggggggtgcaggcccatgaggtggtgtaaagtggtgggtgagccctttagttgtggagtaggagaggcctgggtttgcagaccagctttgtgacctattggctgtgtgatcttggacaaattacttggcctctctgtgctgcagttttctgtagaactacaactgtggctactccaaagggttgccatgaagagaaaaagaaagtagcatgcaaagagcttacttagcatagtatgtggctgagtgagcactcactcaatgttagctattattgttatttgtttctaatactattatatgtgccactggaggtaacattttaacaggcaggagctttaactgccaccaccaccacttcctttacacaccagtcattgtgctagatgctctttctattactaacagtagttttacaggttggtgctattgcctgcagtttacaaatggggaaagtgaggttaaacaacttgtccaatgtcacacagtgttggaggccccagaattaacactttctctcatggtccttcctatcacagggtgctcactccttgctctcatggcagagttaaatgggactgaattccttaatggtagaggtcaccaggaaagggtagccttcctaaatgttcccaagggctctagatcttaacaagtcaccttccagttactgagtgaattgtagaaaagatgcctgaggctgggccagtgacctttacagaatcatggagaccttaaaccctgggaaacgaaagttggtatcctgaaagttttcttaagccatggcccatgaaagacagaaaaagtagggctgcttggggtggaatggaaatgaacagctgggtcgccttcaccacctcctctgtggctctagcatgtcctgagaggcacctgggcaggacctcagggtccagagagcccactgtgaaacccctagagctgtgagtgagttggatgcagagttcaggtggtaaagctctagagggactgttaaagaaaagccgggaaggaagtggagaccgttggaaccagcaaatgtgtcagttgaaggggcttttcttctttagcagatatgggaagggggtgagggagcatgctaagatttattgggcacctgttggctgacttctcgctcagtagctgtgagacttagggcaaatcattcactttctcttgccagtttcttcagttgtaacctggagtgatcatggttccttcctcacaggctggttgtgaggaggggataagctgatgtatgtcaagtgccgagaaccctatgtggcactgagctgagtagggatttgaataaatattaattattgctattaccggctgttacctcagcactttctaagtgacaggcccagtgctaggaactgtatatgtgataccatcccatgccattcctgtgccacctgtgtgggttgttgatatggtgtcagttacagcgatgaaaagtttaagttcagagagatgaagtgacctgtctgatatcacacagctggtgtgcaatggggaggagaccatctccttgaccgctagttgcttctaaaggccttcttccatgaagtgccacctcgacaggcatatggtatggccagagtgaatctaaactccagcaggacatttgggaaattatgtaatctgttcaacatgtatttgttgaacacctactatgtgccacataccataagccctgtgaaggtaggactcacatctgtcattgccactgccaccgaggaaccacttcacatgtttgtataatgaatgaatgggtgagtgaatggatgttatactgagccacatcctcagtatccttgaggagagggtggagagacgtgaatgacttgattttggtattaggtggagtgggaggcaacatgatagagtggacagaaaaatgagaatctctggattggaatcctggacttctctctctgcagttagatgagatgtgtaacctctctgagccactttcttgtgtttggcaggggcaggacaaaagtcctgctcttcttgccttttcccctggctgagatgatcaagggaaatttcttggctcaaggtctggcgcatgatagaggctcaatgaatgttacttgctatccatcctgcttttttttttttcttgaatgatcaataaatcagtgaacccatagttggtatcagccacgagggaatcttttattgaggtgtcattagggtttgtccttgatctctccctgttgacattttcagaaatatgtcaaataagcatgaaacaacagtccaattactgctcccagggcatcctgttcttcatagtatgatccttggttttaaatcctgtgctgcttttgtctattagactagatttccactagggtagggaattaatcttgctcattggagcagactagctgctcagaacactttttttttttttatttgagactttgagtcttgctctatcgcccaggttggagtgcagtggcgtgatctcagctcactgcaacgttcgcctcccgggttcaagcgattctcatgcctcagcctcccgagtagctgggattataggcacacaccaccacgcccagctaatttttatatttttagtagagatggggtttcaccatgttgtccaggctggtctcgaactcctgacctcgtgatccactcgccttggactcccaaagtgctgggattacaggtgtgagccactgcacctggcctcagaacatgtttttgccaaaggactaaataaatggatggatgagagacagagatggccttgcagtaccgttgttgatgggacatagatgggcaggatagtttattgtgcagtagcaccaaacataagaagctttcttgaggtgatagcactgggctgagttttacagaataaaattggacggacaaaactgtcagcctctgcacacggatcctgtaaaccagctgtataaacataagcgtgggtgagagcgaccacttaaccttgtccttcttgattccttagtcgtttggagcagaggttggcaatgttttctacaaatggccagacagtaaatattttaggctttgaggaccctgcagtctctgttgccgctattcaagtcttgttgtaaaagcagccttagacagtatctaagcaaaggagtgtagctgtgtgccagtaaaactttatttacaaaagcaggcagccagcagatttggcccgtgggtgggtggttgccaattcctgatttaaaatacagccccagggagtaatcttacagccatacagcttcacatccaccttaattaacattgactctgggcagctgtgctcccatttcacagaggagaacactgaggcggataggcaaagagtctgttgcagagctggactcagcagggctgttgctccagacatggcaaaaaatatcagctgccacggaacacattatacgtcacgcacttaacatgcatcatccacagagcatcctcattgacctggagaggtctatcctcttattctcctttttacggttgaataaacctgggctcaaggaggttaaatgactgacttatggtcccacagcaaatgatttagcatttatttaagaagatttattgagcatccactctcttccagatgcttttgtacagttggggctaagggaaacccctgacctcaacgtgcttacattgtacttgaggagagtggacaatgaatgaatgaaatgaatcaacaatatagaacgttagaagggaataagggcctgtcagtcaggacaggcatggcttaaagcaagagtcggcaaactctgacccgtgggtcaaatcctgcccactgcctgtttctgtaaatcaagttttagtggaacacagccatgcccatatgcttctgtgcctattttcatgctatgggagagttaagttgctgcagcaggaattgtgtggctctcaaagccagaaattttgtgacctctggtttcaaccagggtttatttcttgttgatgctttatgcccctctgggtgggcccaagagcacagcctattggtccctcagggaaccaggccagtggggcacccactaccttgaatatttgcaaggcaaagcaagattctggaaagagtctcatatgggcaattaggtgcctggcctagaagtgacatgtgccatttctgctcagaattttttggctttacccaacagaaagagttctaactttgccatgggtttagaaggtgaagagctagaaatatttggtgagttgccctgatgaccacatgtgctatgagaaataagtaaccagggtaagctgacaggaagtgccaggggcttttcaattttaagcaatgcctccagggagggcgtggatgagaagtcagctgggatttgagcccaggtctacccatcttgaaagagtgtcctctcaccctccatgctatgctactgtaccctccatagcccataaagaacggttgctgggaaggtcatttgctggccagatggggaagcacactccccttgtgaactcttgccaaaggcctcactgcccctgtccccagccgcctcactccagctgtgggatttctgactctcacaggtcacaaccccatagcgatcacaaccaggcactttgctctccagtcctgggagagatgggctgggggaggagggcgagaggccctctctgcgaggctgtgactccacgaggcactacattaacgttattaataaccctctcagcctttattgaaaagatgctctccgtgcctgaatttgccactatggcaacccatttattaaggctgtaagagctggagtcacttcagaccatatttattaccatgatttgctgagggaaggctctgatctgggactggggcaattgggggagagaacgtgtagttgcttagagggaaggtcttggctcaccttgccagtaggtcagcgagggatgcggtttcattctctcccaactagatcaggactcaaattgcaggtggggagcttgggggttgaacacagtggtgattccttctctttttttttttttttctttttgagacggagtctcgctctgtcccctaggctggagtgcaatggcacagtcttggctcactgcaaccttcacctcccaggttcaagcgattctcccacctcagcctcccaagtagctgggattacaggcacacaccatcatgcctggctaatttttgtatttttgtagagacggggtttcaccatgttggccaggctggtcttgaactcctgacctcaggtgacccgccctcctcagcctcccaaagtgctgggattacaatcgtgagccaccacacctggcctgattccttctcttagtgtgcatacaaggacagcaagactcaaaggagccaagtgagtccccaggggcacagagctgtggccaagtgagcagtagtgggggtcctacaaggcgggggctgatttttctacaaaaatataaactagatttctctctctttctctctctctctttctctctcctccctccttcttcttctcgtgatatataataaactgttttagcaccagaaaaaaaaactcacaacatccacagtgatggtaacaccgccaccagctaatgcaatcagtgctgggctaaaggatttctgttaattcccctctttgaattctcaccatagtcctctgtgggttttatcgttgacctcattttacagaggaggaccctgagttctggggagattaggtatcttgtctaaagtcatacagcaagtaagtgcagagctgggactcaaagccagttctgattccaaagcatgttctcgtatcctgcataccacatcatctccttttttgttgttgttgttgttcttgtccccttttcagattccagaggagtgacaggctcatgtgcatggacaccttctccaataaccgttcctttgtctctctcaggtcccttcctctagaatagtctcaatatgagcacttggtcaatggagtgggatttgcattagtttgctcaggctgttgtaaaaaagttgcacaaacagagtgactttaacaacagacatttattttctcacaattctggaggctacaagtctgagttaaaggtgttggcagggttggtttcttctaaggcctctcccattggtttgcggatggctgtctcttcactgtgtcttcacatggtcttccttctgtgtatgtctatgccctattttcctcttcttataagaaaaccgatcatattgaaccaggcccccccaccccagtgactttatttaagtttatatatattttcttttttgagacagggtctggctctgtcatccaggctggaatgcagtggcatgatctcagctccctgcaacctctggctcccaggctaaagccatcctcccacctcagtctcctgagtagctgccagcatgcccagctaattatttttgtatttttttgtagagatggggtttcaccatgttgcccaggccccaggctggtctcgaactcctgagcacaagccatctgcctgccttggtctctcaaagtgctgggatcacaggtgtgagccaccatgcccagcctcaattttaattacctgtgtaaaggccctatttcagaatacagtaacattctgcagtattgggcactggggacttcaacgtatgaattttgggggaatggaattcatcccatgcaggattcaagaccaacttcccggcatctgaagctctctggggtcagaagagaacatccatggagttctgcagtggagcactggaggcaactggctcctgtctacactgaaagctctcattccccaggcctcactggagcgcaggtcacattgattccatctcgaaatggtcctctcaaaagggcaggaactgtctataattcccaaagtcttctcttccattctaggccctgggcacacagttgccccacagctgttccttccttcacatacttttcgccgttgcccatttaagatgtgcttctgggtatatctgcaatcttcaggcctaggatgcctcctgtttctcttccctgggtttgtgctttttatttctgctctctttccatgactgactacatccttcctggcctccctccctctttcctttccttcttacctccctttctctctcccttagtcctttctttctaactctcttccttacccccaaaaccattctctatacacgtgtcccatgttagggactgtgctagatgctggggattcaatgaagagcctaaactaaaaatttaaagcaaagatagatgcaaaactggaacctctctaacataggccccattctcatgcaacttcagactaggaaggaaaagggtaacgaaagattactgcaagttaatgcatggaaaattgcacctgcgaaagtggcaaggaaaggcagttgtcatgagaacataaaatagaaagatttcttcttgccagggaggccagcgggtgaggctgagctgagccgagccttggaggaggcatgaggcttaactgggcaaggtgacagatggggcagaggtttcatgcacgaggcaaatgatttaggctgtgcaaggaaaaagctgagcgcgattgaagagacaaaagtaggacagtgtaattggaggaaagagagcaagaagcaatgtatgagatgaggttggcagaggccagatcatgagaagcattaatgatttgttgagaaatccattcatttagcctcagtggaatgtggagccactgatgggtattgagcagggagtgggactaggcaaagagaccaggttggtgagtacaaaagatcatccaggctgttgaaagaaacctgagtggaggtggggaggtctgagcatgtggctgggtggggtgggatatgttaacagatagatatctttcattctatgcacccattggactttttactttttccttagtagaagctgtcgcttgtaagaccagatagcaaagacactaaattattgtcttttttttttaagtttattttgagctaattttatactcatgtcatagttgcaaaagtaatacagaaaattcccattcttccagcttcccctgatagcatcttttataatcacagtataatgatcgaaaccaggaaactgacattggtacaatattattaagtaaactgtagacatgttttcaccagttgatatcactgcgtgtgtgtggtttttatttttatttttttgagacggacttttgttcttgtcacccaggctggagtgcagtggtgtgatcttagctccctgcaaactctgcctcccaggttcaagcaattctcttgcctcagcctcctgagtatctgggattacaggcacctaccaccatgcccagctaatttttgcatttttgtatttttttttttttgagacagagtttttttcttgttgcccaggctggagtgcaatggcacagtcttggctcactgggattacaggcacccgccaccatgcccagctaatttttgcatttttgtatttttttttttttttttttgaggcagagttttgttcttgttgcccaggctggagtgcaatggcatggtctcagctcactgcaacttccccctcccaggttcaagcaattctcctgcctcagcctctggagcagctgagattgcaggcatgtaccaccacgcccagctaatttttttgtatttttagtagagacggggtttcaccatgttagtcaggctggtctggaacttctgacctcaggtgagccacctgcctctgccgcccaaagtgctaggattaccggcaagacccaccacacccggctgtgtatgggttctgaattgtggacttttaaattttcaaggtgtgtggcagaaaacgaaacaaccttgccaagctagtgccctctatcccaaatacttaaagaacttctgggtttctaaatggatggaaatgagggagagagcatggcacttagacgtgatgatttagtcctaaaaaggacagaatcaagcaccctgcagtgtgcttctcttggatggctggggcagctctgtggtgaatttccatcctccactcttttccccggctctgtcatccactctactcccagcttttagatttgctgaaagcccacctctgcctgtgctctgcaggccacagcatctcccctcttccccctcccctctcccctttcctatgaggtgaggtatagacctcttgggacgtcctctggatctctttacctatgggccccagccaacctgatatcccccatcttcctggtaaattccttcctagtttaactgtgacttttctgtacctgaccttattctaccactggtgtctgtgttcatctgtatccttccatcgggaaaactcattttcttcaattctgcctttacaaattctactcacccttcaaggcctcagcataccccttcacccctgccaccttgtttctcatcttcacgtgacctctttcaggttttagctcaaatgttacctccttagagaagtcttcccaccccaactccactcccctctgtcctgactgattttgttgctagtactttcagtctctgaagttattctattggttgacttgtttcctgtattttctacaggaagttttgagtacgtcaagatccagtctgtcttggcctccactgtaaccctggtacttggaacaggggatggcacacaaagatactcagtccgtatgtactcagagactgattgacacataaattatagtgattgcgtttagttaaataataataataatgaaaataataataatagtagttttacggctggggtagccgcactttcctccgaactctacaacttgctgtcttggcttttgctgtggattgctctatatcaagggtcacagatgaatctggataggtctgcctttatgcagatgcagagtcccttgagagggttggtattcttcatctctggatctcctttagcccctggcccaggagttggcacttggaaagctgtcatggtaaatattctgaatgaacaaatatttgaatgaatgagaaagagcagctatcattgcttctattttgcaactagtaatagtccagtttagtgtgcagacccatgccagcagcagagctgggcagaggagccaggcatcatcctctctctccccacaccctctgcatgcacttggcctccctgtctcctgctctctaggctcttaggagtacaatatagtttgtacaataagtacaaacccataaagctccctccagtatatcttgcttaaccgctcttatcagaatagaggagaactgaaagggctttcgaaagagccatctgttagttttcataaagacattatgtgcttcccatcacagggtttttgctgtctctgtcatgtgtccgccctccctccgctgtctgagagagcaggagcgtggtgcctctccactttcctgtctgtgcatggctgctggaggtgggctgcagatgagtatttatctaaaagtgaagagatctgacttataagcaagcctgatattaaatgtataaataatgcatcctgtggcattatttataatgcaataacatccctataatgtaataaaagtatgcaggttcccagcacttttcttaaccccttaatgtcttggaagatgctgtgggtttaccagcttcctcatgcctcaggggctttgggccatatgccaagcctggccaggccctggctcctaaacagctgaagcgtcttcataaccacctgcaggataagctcagtcccagtatatggggtagtgatttccaaactttgttgtgagtcagaatggagatttcctaccttcaacctactgttttggaatctcatagcatggggaggggacatttgtgtgtttaaccagctccctggtaggttctaagccatgtacataaggactcttggtcagtcctgccttgtgacagaatagactaatgagcagctccagatcattgctatgggactcaaaatcaagtcaatcttgctaggactgcactggcctggtgcctcagtttcagctcctgctcatctgcccagaatgcacattcctcctgtcactcaacatcaactgtgtgtctgaacccagccacccgctggcaggctccctcaaggccaactggtgcctaaccggtcctctgagttttgcctgctctggtattttctcacttatcaggtggcagaaaactctgggttgacccaggaaaccagtgcttacttaggtgcctgtgtctgatgtcttgtaaattcccctggtttccagactggcctgggatcccagtgctacccagagatctacctttcttttggggtctgtttctcattctccaaagtggctgtcttgtggtatctagtgtccttggatttccaatatctcccttttacaaaaaaaaaagacaaccttatatactgggacaatgaaaaaacagaacccatcagtggcatggatactctgaactttctgttcctcaccgtggctgcccaccttcaagtatatctctgcctgtatccatgctgtctgtcatctttcccaccacaatggaagaggtttatggtctccaccattaggtgacattcctcacttgtgctctggaccccaaccctgcagcctccccaggtaactctctctatagacaatctcttctctttctcctgaatcttcaacatgtttccctactggttttccatcagcttctaaacatgatcagcttctctcacccaactatcatcatttggctcaaggcttcttctagctactatcctatcttctcccccatctcaaccatatttcataataatagtggtatgtatttgttgactcttgtcaatggatacagtgacaatatatagtgaatgtgctaactcgcctagtattaattattttttttcgagatagggtttcattatgttgcccaggctggagggcagtgggctattcccggcttcattgtagcataccacaaccttgaactcctggcctcaagcaatcctctcacctcagtctcttgagtagctgaaagtacattgtacttggcttaacttatttaatcttcacaataatcctatgaaaaatttatactagatgagttaacacctaattaaggtatagagagatttggtgacttgcccggggtacatactagtgtaaggtttgatcctaggcagtctgacttcaaagcaaatgtctacatttgcctgtgaatctttctcacctgttagtcctccacgatttgatttctactctcaggtcagcagagatctctgcattgttacatccagtggggacttttggggcctagttgcacctgatagcactgacctccttattcatttttgaccttcgcttcttttgttcttgggtccccacagtctccttgttttccttttacctctctggtcacttcttagtcacatttgcaggctcttctctcttggcccaagaccttacattttgggatgttccagggttctattcttttccttctttccactctgcacactgtccctgtcttaatttgtcaactacattctaagaacctcaagtttttgttctgataactaaaccagaggtccatttgtttgcttaaaatctcaaaacaaatatttccctaatttaatcaatatttggcctgatgtcggctcttcctcttcccttttctgtctcagtcaatgaccaccaagcattcatccaattgctctggctgaaatttgcatagcatttttaacttttctgtctatttttttgagacggagtctcaccttgtcacccaggctggagtgcatggtgcgatcttggctcattacaacctctgcctcccgggttcaagcaactgtcctgcctcagccacctgagtagctgggattacaggcgcacgccatcacacctggctatttttttttttgtgtgtctttagtagagatggggtttcaccatgttggccaggctggtcttgaactcctcaccttgtgatccacctgcctcggcctcccaaagcgctaggattacaggcatgaaccaccgcaccctgcccaacttttctgtctcttttacccactctatctaaacaatcaccaagttatatgaattctatctactaaatctcccctactctcaaccccgtccactttcgcactcctcctgatgccccctgggtctcaatttccatcatctccttcttgaattcttgctaccagtttctaattggtctcttgattccagtcttgtggtcctctatacattagttatgaactatttaaagtatacagaaaattacagataatggtaaaacagacactcattcatctaccacttagatttaacaaacattagtattttgccatatttggattaactaattgaaaaataaaatgttacaaatacagttaaagagccccattcttttcttacacatctttctatcccaaagataactactgacaagctggtgtatatcttttctatgttttaaaaattcatatgtaaatatatatctacaatttgcatgatttaaatatttaaaattcatataagttatactgcatgtataattctgaaaaaaattaatattatacctttgagatttatcgatgttgatacgtagagctctgattcattcatttgagctgctatgctaaactgtagttataatctatactttccttatcagtttccctatccctggttgcatccagcctttctctgttataataaacgcttgaagagaaatctgcactcccatgtttattgcagcattattcacaatagccaagatatggagccaacctaagtgtccatcaacagatgagtgaacaaagaaaaggtggtacatatccacaatggaatactattcagccataaaaaaagaatgaaattctgccattcctggaaatgtagatgaatgaaataagtcagacacagaaagataaataccacatgttctcactcatatgtaggagctaaaaatgttggactcatagaagcaaagagtagaattgtagttactggaggttgggaagggtagtggggagggaagaaaaaggaagttggttaatggatgcaaaaatatagctagataggaggaataagttctattgttccatagctctgtagggtgactatagttaacaataatttattgtatatttttaaatagctagaagagagggcttttaatgttctcaacacaaagaaatgacaagtgttggaggtgatgaatttgctaatcaccacatattgtatagtgtatccaaatatcactctgtatcccattaatatacacagttactgtgtgtcaattaaaaagaaggttaagaaacaagcaagcatgctatgccttggcaaagaaatgtcttagatgactcagaaagtaatctgagactcaaagatacacatggagaatttaaacaaagttgttccatgttgtgaaaaaagtgctgcaataaacatacttattcaaggatccttaaatatttatgtgtttctctccttttcagggttagatcttgtatagtctgttctcacattgctgtaaagaaatacctgagactgggtaatttataaagaaaagaggtttaattggctcatgattctgcaggctgtacgggaagcatggtgctggcagctgctcagcttctggaaagtcctcaagaaacttacaatcatggcagaaggcagaggggaagcaaggtgtctcacatggtgggagcacgagcaagagagagagggggaaggtgctacacacttttaaacaaccagatctcatggtaactcactatcaggagaacagcaccaaggggatggtgataaaccattcatgagaaactgtctcccaccagggcccacctccaatactggggactacaattccacatgagacttggtgggtcacgatctaaaccgtatcagatctaaaatgagaatagttgagcattatgctataagcatctgtcttagtctgttcaggctgctataacaaaatactacaaaaaggtggcttataaacagcagaagtttcttacagttctggcatctaggaagtccaagatcaaggaactggcagatttagggtgtggtgagggtccactttctcatagacagtcttctttccactccaactgcacatggtggaagtggtaaggggtctgtcttgggtttcttttataagagcactaatcccatttctgaggttccacctccatgacctaatcactttccaaagtctccacattctcttaccatcaccttgggggatgaggatttcaacatatgactttgggggaacataaatgttcagctcacagtgtatctttaccagattttgccattttttttacaacggttttcatcaatttatacttccatcaagagttatcagaattttcattttcttacattttcaccgcaactcacaaatacttaaatatgaagagtgagaagtggtacatcattgttttaatttgtgtttaattgtgtttcatacgagaaatagagcatcagagaaggaacaaaatttttgactttccaggttatgaggactactttgattgaattaaatgggtagggcagaagtctgctgagcaggaggggcacacaaagggagaacacagtaggaagggttgaggtgggaggagcctgcacttgtgatcaggacttagaatgtgtgacaaaaactagtgctgcacatatcacctgagctgagactgggaacctcttctgactcatcctcagatggaaataaccccagtgactgctccctgcatcccacagaaaagcctgcttctggtgccttctgtttctgagttgttttaccttgcagcctctaggtggcgcacctgagttctagctgctcaggcctgtggaaagcgcagggatgactaacagaagaactgggagttatccaagagccgaggtcctagggtgaagaggtgcaggggagctcaagccagtgtttagtaataattttaaaaccctaattgcaaggggtgaagcagattataacagttacagtgatgatatgaagagcagtataatacagattttaattaatttttcattcagcacatatttgttgaatgtctgttgtatgctagcaactgttgtaggtgctgggcatgcaattagcagtcaataaagcaagacccctgcttgcagtctagtgggggaggaagataggcaataaggaaacaaaatgcttggatgcaaaggacagagtaaggcaagtggaggaattagtgatatggtagacacactaggggatggtttcccagagcagagttttgccatatgaaataggagcccaccttgcaatccagccagtggagcaggaatagtaaagagaggactttagggattggggaaaaatgtgtgcccagacccagaagtctcaaccacaggaaggagggactcaggaaactgtctgggagtcactgaatgttgtcggttgtgaagtgcagggagatgaggccacagaggtgtttaggagccgggtcatggttggacaagctatggggttggagctttatccagtggtgatgggaaagcagagggcgattttaagtgagtggatttgccagtagcatcttgggggataaactggaagcggggagacttaagctagggagactagtgggaggcagtgtgtgcagctgtccaggaggtgtcagggaagaggtatggggcctgaatcagctcagtgttactggagatgaaggaaaggaggtaggtttgactgaatttggtgaccgactgaacatggcagtgggagggacagggaggagtcctcaatgccctggcccctggcctgagtgaccattcacattgcctgagtggctccctttgccctatgcatgtgtcttcctgaccccagagtcatttttattactttcaagtgtgtagagtaaccagaactgaactaataaagtgcagcagttctgctttaatgagcagaaaagagtaatttgtaattagcatatacattatttgtacataatgagtgcttccaaagtccttatggggttgtttgtcttcctaagtatttaaaaccccacctcctcccaaccatcttgtttatgctgtttatttgtactatctgttcttaaaaatgcacccacgtgcatatgtacacactgacacattcattcgcctgcagccatctgtacattgtctgcagccagagaggcacacataggaacacgcagctaccatttcactcatttgtaaatgtaaccccacacttgcatgcaccagcacagatacacaaacactcaggtctacacataaaaatgcacatgcatgtgtacacacatgtacatgtacctgttcccttgtatatacacatgcccaggaagtacacagaacatgtactttcataagaagccacaggtgcaaacttgcatttataactgtgcccatgcacatacatgtgtatacacacaggtcacaggcctacatgcacacatgttcaaacagatacataaatctgggaggaattggggcttcaattggtctctttctcctcaagtactgatgatgtaaagctttttatgattttggtcttgtccaaagatttgaggttttggagtcttcgtcttcttgttcaaagcatcttgttcttgtgtggatcagctactgttagctaatgttacctatctgttaccctgctggaaagctggatttatgaatgatccctaaaataaaggtcctatgtgtaccacagcaataggcctaaatgagtagctgagaggtgaacttttgccgccttgggaccaggcctctgctggggcaataagcagtaaataactgtagctagtaccattatttttgggcccttacacaaaaaactctgcatagtgataaggtagactgaaaacaagcagcttctgagtagtaattgtgtaccaggatttctcatctacattgccacatggacttactctatagcattttgaggtcagaataattatccttatattacagataagaaaactgaggctcaacgaaatgaaagcatttgctcacggctgcacaaacatgggtttgaacccaggagaatctcttgcattatttaatctcttctccttagctcaccaccctctaccctgctgggtcccccaaacacagggtctgctggagcagatatgagacaaggacagagctggtgatagtctttggtgcctctgaacttgcatgaggtgtttctgcatggttgaagagcaatgatgagatgctccattcacccaagggtcagaggtggtctttcctggggaaaacatgactcagcttttctgaccttgtggttcgcttttgacatgactccagagaaggtgctggtaaagccatcgtttctctgaggatttgagtagataccacacctcagctccaaaaattaggttcgcaacaatttacaataagatatataccctaggtgaacaagcaaaggaccaggactcctttatcgtgttagaaatgtcatagttcctaaaatgtctaagctgtatggttggtcacctgccattcattggccaagcattgtgcttagatgaacctgggcataggaaaagttgaaggagacatccaggccacttttggtttacattactggaaacattttaaagacaaaaaatcatgcagatgtttttatagctattattttattttagccttaaaacactcatgaggaaagtaatgttaataacaataatggtgacaacagctgacttttatcgaatagttactatcaaccaggtcccacaatactctcaatgtgctaagtgcttcacgtgcaatagtctattcaattctcacaacaacccaatgaagtttgagtcctacagtgggttattactgctccattttcctgttgaaaaataaagaatcagtgaggtaaagtgacaggggcagcatctgcggtagaatccaggtctcctgactcttcagactgatctcatgtcctagtaccatccagggtcagagactgcaagggcaggtggaataaggttagggtgctgggaacaatatgctggtgtgtactccagcctctgtggccctaaaactgtcacaagtgatggtttccaaccaagtcaattgggtgtctgactttcatcctgggaccaggaaagtggggcttcacgactgccttgatggtactggtttgttttacagtgtttgccagtttctgtggtgtaaatacttacactatgtctgatttcaagctagcaactgtttagcaattgggagagaaggatagagggagaagggaagagagagaggcatttgcttacatcatgtctgatttcaagctagcaaccgtttagtgattgggagagaaggatagagggagaagggaaaggagagaggcatatgtaacaactgcatatttaacagttggctttctggctcctccagccgactgcttgggcccaacaccctagcaattaaccttttgctactcctgggctccaaggaggccaggccgtgggaacagagcaccagaaggatatttcaaggcagtttctccattgcctcagcctggatgaggctgatagtgttttacttcttcctttgcctccctcagggagaaaacaaagagtggatcccagaaaggccagggcctctaatctctcagtacaagtctttgaaaggagaggaagggagctgggtctaccgcagagagctggcaaggctgggtctctggaggctggggccaggggctccgcgtgtggagtatggagcagagccggtgggctgggaggaaacgactggcggaaggcctcctggaccctctatcctgtcttcataactcccacacagattaatgagcctcaggatgcccttggttttggccagccatgcttggggcctccccaaaatagacaggacgcccagtgcctcttgctattgtcccagctattgtctttatgagcctcctgggttcagggatcacatcctaactcttcctgttcgtgcttaatcaccatccggatggatggacacttgcagacagactgggggcaatgcagactcagggaagccagtactgtgtgcgtgtggagagatctggccccaccgtgtccatggctgaaaagggagaaatggggccatggtggagcttttgcaaagactcagcgctcctttcttggctgaggctggctgagggggccaccaggctcagagctggtgccctggggtagggcagtgtatggggcagagtcagccactagggggcaggccccgacagcaggtgggccaggcaaaaccctgtcaatgctcaaaaggatggtgggaggactgacagccacaaaaactgacccgcttggggtcttggggccccctccagggtctggtcagctccagagagaaccaacacccaggggagtctgggaagcaaggacagcagtgatgggaagctatccgtagattccctgtatcatcctagtctggggtgatggaactgtgatgagccgcatctgcgtctggatggggatgggcacgtggcttccccctgctgtggaagatgcaaggagcaggaagaacagtgacagagaaggacaggcctggggatagggtcaggagctggcagctgcagccccagcacaaaagccagatgcaggaaccctggcttggggtatacaagcccctgaaggggcctttttggtttgtatcctcctgggcctgcctggccaggccagcttcctgttagcctagcaaagctgagatttgtcagctactccaaagcagtccctgcccttcctgctcttgactctgcagtattttgccttggttgattctggcagcttgtgagccctctgagcctgctgcctgccccggatgaagctgtctgaggttcagctgagctgtctgaaagccagagaagcttaggatttaccctgagggaaaaagactgggatgcacccactactgggaggcctgatagacccagtgacctatggcaaaccatttattctattcagccattctcccatccatccatcccctccatccatctagcccctcatccatccatccttccatcaactcacccacccagccacccacctacccagctactcatttatctaccctgccatgtatccctccatccttttccatccatctgcccatccttccccattcatccatttatcaatccatctattttccatccatccattaatctattctatcagtatatgtcattgaaacttcctctgtgccaggctctcttttgggtcctgagaatgcagcagttcacatgacagaaaaagtttctggatcataagagctaaatttgaatggcaatgtcccagtgacaagccaaatcactcactatgacataaggatggaaattgatggctcagctcttaatccatcgaggcagcaaactccctacacctcttgccctgatacatacagatatatttacaatatgtatgaaggcaccccaaaatatgcatacctgtgtatgctcacattgcatccccttggatagcaacatgtcttcaggataatttgtgtacacataccaccatacccgaatgtataactatctaaatacgtgcatgtgcatggacataaattcacatatgcacacatgtacgtataggcacacaaggcacttacacatatttgcacatatacatacatgtgcacatatacatacttgtatatgtgcaccaggaacacacaggtgcacacacacacacacacacctgtgcacagctactcaggcacattggcatatgcactttaacttcatacaaatatatacacttgggtacagtttggatctgtatgcatataagatacatgtgctcacatatgcacctatccatgcacacaggttgcatgtacatgagcctacacatgtgcatgtaaatactccctctgactttgacctttcaccaaaacccccgaaccctaccatttccccattctgtcctggggaattatccatatctctgacaagagaatgggttactaatgcagccacagagctgttttgacacttttgatgaataacattcaatactattaattggaacaattgcttttcatttaactaaatcatgggaattgctaaactaaattgaaacggaatgtgattttgcttcgcactgctttaatatgggcctctaaatgtcttctctctgaaggattagtaacttaatcacccaccagtgataactgcttcccaggctcagccgggaggcttcctgctcagcagcagcctggctggtgaggaactgggggcccaatggcaactactctgccccttgcttcctctccctgcattattcatcgtgggggaacacggttctctcccttctctgagtccagcaggaccctcagagacaatttccattttccctgggctctgcctgtctgcgtcctgtcgaggagctctcattccaggatcctggatgtgggcgtggattctgtctctgagcttctctgagccttgctggaacacttcgtcctgagaacactggctctggaatcctggggccacgtataccctgagggcagcccagtgcctggcttagcttccaggggcaagttgatgtgggccagaaatgttccctgcactgcctgggggagcagggaaggccccagccagctgggctgttgcagggtgaccaactgttctggtttgcctgggactgaggggtttccaggacatggaacttttcagggctaaaactggaaagtccctggcaaatcagaacagctgatcatcctaactgtggtgtcatctgtgcctccagctagaaatcatgtttaacatttattgagtgcttactgtgtgctaggtgcttgacatacattatttaaatgttgtgacaatgttatggggatatgttctattaacatattcattgtataagtgagaaaactaagactcagttattttttaatcttatctatgtcctcacaggtgtggacacaacaataacaacaaggataacaaggataataggagctaattttataagagcttgctctgtgataagcacttctgctaaaggctcaatgtgcatcctacagcaatcttgaagttaggtaccatttttgctgttccttcacagaagtgaaggttattgctagtgagtgctagactgtgattctagacctagcagcgtctcccaccagcctctactgtgttggcttgcctgttaggctacatggggcctcccaagtccttttcctctgggtggtctaaggagacccaggctacaggattctggagggtgaggtccttagcaaattgagttgctgagcttagtgtggcctcttctaggtacagcttctgtccttgggtgtgcaaaggagacatggccactccctgaatagggatttcagggacagccaccccacccctttccactgacacggttcctgacactgggtcctctgagtggatttggcatgtgattgtggggcctgtgagttcttataaagccaggttcttgcctgcttctgctgatctaggacttgtttggactgcagcaacttgtttgccctgcagcatggtaggttgccgtatctgcctctccatcctctcctcctccccagccccaaggttgtcaggaaaaattgctaaatttggctctgagttgtcactccaaaatatttacaggaagagaaaggagcctgctttaagggggtccttattggaccactcctaagggtcaggtactgtatcaggcatttcggtttatgttctcatttaatccaacaacatcccaacagttaggaattattattcccatttcacagttcagagggcaaaggtgctgaaggaggcccaagttcatgcacctggtcagtgctacaccacagtttaggaatcagactgtttattccactgactcaattctcttcctaggcagatactgccattctctaaagcgtagctacttccgacctccaagtttctctgtctctctggagagggctcagtgtgctcagtgtgatgatgaagcttgcaggctctgaagacaaatgaatatggcctgatgcctggtgcttcatgaggcattgggttgagatctgcttgtctgttggagtctttatgtgtaaaatagggattcacacagtcccgacttggtagccctgttgtgttggttgcacaaagaagagctcagcacagggcctggcacagggcaggggattaataagtggttgctgctattatcatgtttatgatttctggcagtttgaaaggagattctctggagttcagtgctgtagatgtcaagccttgcctcccctccacatctacgctgcctgcgcccttgagtttcctattaacttaataggcctggacgtaaaggagccagttgttcatgggatcccagagtcaatcaacaatccacccttcactgcttccatttggtaaaatcgatatgtgttgattgaacactgagtctgcgcagagccctgaggctgcgcctgaggaggattcaacctctcgctgtgccagggagtgtaactaagatagcgttctctacctgggatccctggaccagcaccatcggtatcatctgggaacatgttaaaaaaagcaaatgggcctaccctaaggcccattgaatcagacattctggggttgggccccaggaatgtgtgttttcgcaagttccccatatcactctgaggcacgctaaggtgggagaagcattgctccaagagaccaaaacgcagctgtcctctgacaaggaccagctaagcctgtgggagcacagagggaagagaggaggacccagctggggaacctctggggagtggggtgccctgacaaattctttcttcctgctcgggcttgggaaggggaggagccagggctgcagtgagtccgcctggcaccttcgaccgattagacaaaggtgccttttcttctgcgaggatgcagcgctgccggtgaggggtgcgtaggctgggttttcatctcatttacccttcacccacatatgcaaggcccaggcaaagtgtatgataggcctgggtgcatttgacaggggaagagccgaccatacctgtcctctgacggtggggggtggctcctggaatgctgagctagcaaccatggtgagtccccctactgtgtggacccttgccaggcctcaggcctcagcagtcacttacataaaacaggtggtgaaggccaaagcctggggagaaagaggataatcagagtcaagtcatgaagacagcatgccatgggctggaggagatgtcccaccctgagccaccacaggagaaaataaagcaaatgattgacagcccctaaatgtgcgggttcctctagagcactgtcctcctgccacagacaaatcagctggattttgatgcaaaagtcaaaccaaccaccgagtatggctgaggaggaagagaaggctgttgccctcagcctgccccagtcagtgccacacagttagccttttacttccttctcctttcctccctctctccctggggaccctctcagaccactctcccaaggccagctggcctcattcccatcctcccaacataggctaccttggacttcaccacctctagattttggcctgcaggagcaccgctctccactgagagcacttgctgtctcccttacacacctgttcttggtggccagtggctcctcccttctccttggcaggtgtcctaggttttgtcttctgttggtttcatggaacactgccttaattgttcctggggctttaatgggaccctgtcctcttctacattcttctctctcccagaaggtgacttcttgtaggtagggggtacttgagtctcctcctctgttccccttttgtcccccagactgggaactttttatagcaaagttaagtctctccctgtctctgaaccagttctccactccaacatttgctaccacaagttttggacaaagtagagggagagggagcccacccaagtccagctccaggggcccctagacctgctttgttggccctgtctatgtcccaggtaccacaattgtggcaggtcactctggagggactagctatcctacagccccagacaatggtctgggttctcgttccctatctcctacccctcaccccatatacaccccgtatacccacacagcatgggaggtcactaaaactcatcactctccctggaggaagcctgaagggcagctggactaagtgcctccatccaacacccttggaggttcacacttatttctgttgtctccataccaacagtgcatcaactctcatcttttctggcccaaagttggataaagccccagctcaagttctcttttgtagactggcaatagagttgagaaatgtaaagaagacggatactaaaagatgaagaagtagaacttccaggagaaggaagttcttaggcagttcgtggatggggctctagctaggtgtagtgaagttagaaatgtgtactttctaagtcagacaattctgagtgtcttgtatttactttcatgtttctcagtgatctctaacatttggtccatatctcacatccttgcccttctccagaaattttcttctttgatgtcgtaactattttctggctcccaaaatcaggtgaacctgggtaccatcttccctgggtcctatgacctctcttgctgtgagatgccactcttctgcctcttccccactctctgtctccatcttctcttctcttttattgacatgtcccaagggtgctcttctatgttctttgatctctcccatctgtcttgttcacctaagctgtccctttcgtctctgcacatagctcccaaattccaattcttgcttctaagaaggaccctttggaactgagagctctatggagctaccctccagcataatcagttgcctagagacattttcaaatgtagtcccggcgagtatctaaaatctgacctgcctccaactaaacccaatatcttccttctcactagcagtagcttcctgcctcactctttctgctaaaaagtttcacccagactcgaaaattaatgtgtttctttcttgtccctattttcttctaaaaatctgatcggtaagttccagaatttccccaccgtgtcctttcctctcctgtggactgaacccctccctggctcacacacttgccccactgagggcttcctcccattggcagcttctatgccattcatccaaaacatgctgcctgccaaacttatctttttattgcccagcaaggaccatgtccctctgctacttaacaatattctagagcattatgccaacttctccctgaatcctttcatttgggaggttcctatgagtatagagcttagactataaggccagtcagacctgggtaaaattctgactctgccattaagtgagcccataggagagtaaacacacagcccttaataaatatgatttccctgatttattcaagtacaagtaagtttacttttacttttcataattttatgtctcattcgtacttctcttttggtatccactacttttttgtatctagctattttagtatgtattttctttttaaaattaatttcttaagcagaacctacttagatattttaaaatgcaataaatattatgtagaaaattagaacatattaacacatacggcctcagtggccaaagctgtaatcagatgtcaattcatagctattcattcctttgctcttacctggacaggagacagctactgaccattaaaatctattgtctctttccttcattttaatagatgtgctgggtacatggttactcagctacactttattttttattttcccttgaagttagatgtgattgtgtgacttatttatttaccatagaatatgagcagaaatgctttgtgccatctcccatataccccctctcatatattcccctctgtgttttttccctttttggctgattgagatggcaaaaagtaggcttggaggccattcgttgaagatgacattgtcactatcagcctggggtcctgaaggacctcgtaggacagaatctcagccacttggaacctctgccctggacagttatgtgataattataaaatcagtcttgcttttaggctactgaaatgtggggggtctgtttgttacatctgttaatagttagcctacctactacttactccccatggtaggcagaactttggaaaggtcccattctaatatccagaacctgtgataaatacaaggaaatatcattctcatgattatgttatgttttatggcaagttgaccttaaaatagggagattatcctgggatatccaggtggagtcaatgaaatcgcatgcgcccttaaaggtagagaaacttctccagcagttggcataaggggaagccagaaagactcaaagtaggagaaggagtcaatgtgccattgtcggttttaagctggaggggcctgtgagcaggaatgtggagtcccctatgggcagagtggcccctgactggcagtcagcaagaaaccctggaatccagatccagaactgcaaggagctggatttttccaacaacgaagctgaagctggaatcaaattcttcccctgagcttgcgcgtcagagtttaccctggccggcactgtaatttctgtctgtgagacactgagcagagatcccagctgagcccacctggattttgacctatacaactgtgaaataatcaatggcattgttttaacccactaagcttgtggtaatttgctatgcaaaaatagaaaaccaacacagtcctttagaaggcaaggactcaaatcttattcttctctgctctctctgatgtctcagggtagcacctggcatgtaagaatttaggaagcttttgttaaatggacaaatgagttagtgtggtgggtgagtgagaatcctcaaggtatagatccaaggtctgtaaacctttttcatgaagggcaagatagatagtaaatatttaggctttgcagggctctgtcacaactaatcaactctgtcactgtagcacaaaagcagtcatgatgatatgtaaataaatatgcatgactgtgtgccatcgaaggtttatttaaaaacaggtggtaggtcagatatggcctgcatgcaggagtgtgctgaccccttttatacatcattggaagactttgggtactttcatccaaagatggggaagcttttgcctagaaccacaagacttaaataaatggcttgagggcagaaatagtttctactgtaagaaatacatcatcaggcctgagaggtggtttagattgttccagagcacatggaactttttggtttctagggagataaatcccattaaaaagtctcttttctttctttggctttcaagaattcttctattaacatacccttacctggttttcccttcttacaatgagatgggactggctctctggcctggcagaaggaccctagcctgcagcagtttgcagagtaagggatttactcagctggttttcagctgagcccccgccccatgcctgaagcctgagtgaatgtctccagccagcccctgggcagagatggtacattgcttatgggcctgcctgcccatccttcatgaatttttattaaacaaaactgtaagcagattgattttgtcctcttttattgcatttttatttaattccgttccatggtggaggctccatcatgttaccgcagagtaaatcactccagggcatcaggccaaaaccgtggagaagggcaggatctggcttcccaagagcacatttaccgcataagaacctttattagcagagagccattgatttcttttttttttttttcaggtcatagccccttcacatcctttaaataagaaagaatcacaaagttatagtggaagagagactctgtgtggccagggtcatggggtgctagcttgtgtccaggtctgacaacatctgtactacccgtaccctcaactcagctcctactatgtgctgggtggggtcatatgaaaagcttggagaaaagtagtttgggtggagcattggtggctgatacagatggaagggaacattaggtccaggaacaaagtactttaatatactttttaaaaaaaattacgggtggttatagtttagcctcagacctttatgtaaaaagtcaagactgtgacagctgtaatctaaatctccccctccttccatagctcctactttcacactccaggtaaaggactttgggattttatccttaggaactagagagctactgcctgttttagagcagggcagtaacaggatactattactatctttgttagaggggatcaatctggcagcagaatgtaaactgaatttgaggagagttcaggagtagggcagggttggaagctagaaatgggggcatcagttaataggatattgccatggtctagccacaaggcaacaagaacccaaagttgaagtaatgaagttgtagaaatagtaggggagagagattaaacaacaaacagttggaggcgactctgaggttttgtcaactgcaaaagggagtgaaaggggtgaagtggtttgagcaaagaaaaagcagagctgagtttggtacatgcttatttacaaagtaaaagaaatacttatatatgtatatacgttattgcaaatgtgatgcagataaattgcagaaaattaaaaaatggagaaaagcattataaagaaaataaaaatcatatttaatcccacaaccacagtttgccattgcaatagtacgtttggtatatttctttctagatagataaataaacagatggagcatggtactaagtagtcttcaaaaatatgattctcactcgctgcgtattaccatctggatacaccaaaattgatttcactgtgcatcaattgttggactttaacttgatttatagtttctccacactataaataatgccatggtgaacatcttgctgtatgcttctttgtctgcctctctgataaatttctaaagtaaaatgattgagttaaaggttataatcttttttaaagttcttaactcatgttgtcaaatgctcactcgatacttactgatacagtgtatgttcaggttgatttcacagcacattcatcaatcaacactagaattattttgatttttttaaacccttggcaatttcacagtataaaagggataatcactatttcttaaattatttgttttttattattactaatactttaataataattttgggtgtgcctattggccattttcaatttctcctcttttgaaaattgtatcattttttcatatttctgttggacaaaatctgttttttatgtaccagtttatgacaacttttaatagtggggctattacagttttgtgtattagacatgttgcagttttttgttttttttttttttttgccacattctcattacctttcaaagttttatatggtatttttgataagtagaagttttgaaattttatgtagtcattgctatccccttttggattttttttccttttctgttatactttgacagtccctctcaaaacaagattcagtaaacatttacctatgatttcttttaattctttgtgatttcttcatttgtctccttatttgaagcatcagcctgtggtgatcatgaacacaggctctggagttacatggacttggatttggatgctggttctcccaattacttgctgtgtgaccttggataatgcttaacctctctgaaactcaattttcaaatctgaaacagggttggaagttgcaggagataatgtatgtcgaagtgtccagcacattacttggtcagtagcagacatgtaatcttaaatattgccacgttaggtctctgttaagtatgtacaattttgatcttcatgaaggcagagacactgtcttatttacctccatatcgcatgtctaactgaggacatgtcttaaaatatattttcagtgactatttgatgaatgaatgtatgaaatgagcttaacagattgcattttgtaagttgtaaaggcaaaaggaattcactttaagacgtcgaactcatttagaaagaaccagaatagttactgtgcatctagaatgtaaggaaaaaaagcaaacaagaaacaaattaacactgttctttcattagctacagctcgccattcagtcttgtgggtctggtcagtcacctttgacccctgacctcttgccttgacctaggcatacaggccattgccaagctctcttgagtctgtatgtagagagattttaagagctcatagggccctctgaggtcatttggtcagctcaacttccagtatttgtattttagttgtcaagcacttcttttctaaaggaatgtgaccctgaaagtccaatatgtaaaaacagactgaggtagagatgccatgattgaaacacaggatcaggaggtcatattccttctactgagggctttgcagatgccgttctcttggacagaaatgcaattccatcctccctgtcccaattatccggctaagtattacttgtgctttaggtcctagcttaaataacactttcttcaggaagccttccctgaccttcttttgaccaggtcagttttcccttctgtatattcatagtcctgttacctctatttgctagcacacgcctcagttgcaaatttgcatctattaatattaatttcctcttacactaggagcaaaatagaggaaagcctgtgatgagtttgtttactattatactccgggcactcattgcaaggcctggcttgcacacaattggtgtcacttaatattaataccttaatagaagtgtatctgatttaatcccattcttttccagattgcacaaatgctactgtgtccactgcatgccagatactctttgagtactggaaatacgctagtgaaggaggcggacaggagtatgcgtctagtcaggatgacagacaacagaggaatcattaatttcaatggtgataaatgcatttcatacattggacctctatgtaatatttaatcagaagataaagttcttttactgaaaaataattagtaggtttctaggccagcacattttgtgggtcatgaagtcagcagctaagagtggtacttggaatcttgtctttgtggttcatttagggtgggagagtgtctgtgaggcccagccaccttgtcagaatggaagtttcatcacccgctgatgagtgttagacagtgcgtcagttcatctcaaagttgccaaaatatgcacctacctgggtctgctttgataaatagataagaacttgtgttccttgcgagtccatcagaactcagttatcataatcatctgtcacatgttccttaaccctatgggcaattctagggaggtggctgatctagatgaaagaaggtccttcagcaactgtccagggcacttggaagaatatccaagctccccaccatgacctatgggcctgtgctgatctcggtctcttctccctgcccatcttcattttgttccatggcctctcatgttgcagatgtcaatctcaggtcctatttgaattattcccagttgcaaatcaggaaggtattaattggtgcatgttctgtaagtgctgttagaattagagctactgggctggctgacaggagtttagagggcagcccttttcctcctctgagcctgtctccccagccatcccttctaaaagttgctgggctgatgcttgtatcttggctggctctgatgccagctctgacggggccaccctggaacctgcttgcacaggctgtcgagggcgtgagaacccaagcagacaactcccagtcctacctcctttgctgtgccaggctgccagtgccagctgaggaggccccctcctgcctctgcttgtttcccttgattgttatgtaatgttcggcagcaggaggtaaattcctctccaatttccaggcccgttacagcgcatgaaccccaccgtggggagccacagtgattgagctcagcagccaggtcccatgctgagtgtcataaatcaggcctattaccagcttctcctggcagatgccatagccaagaacctgcccactgcttgcgagacccagccgcctctgcatactgttaaaccagggctgacagatccaccggggatttaggggatcttcatgacactctggctgggtgttgccaggaatcttattctgagagagcaggaggtgacacagcccttggcaaggcatctcagacctgagatctcacagcctgatgtacggggagcagaatcagggcatgatcacctgcaggctacctggatttcctggtatggtggcctcttgtgtgcctggctgtacacgtaagaacctctaggggacttgttaaaaaatatacatctcccaggtccatccccagagattctgatttggtaagtgttccttgggacatggaaattagcattttttactagatcccaggtgattctgatgcaggtggttcctggaccaccctttgagaaatgctgctttgggaccagctgtatccctgaagtgatgcctgtaaaatgaatgcctataaattgtgggtcttttttttccatttccttctatcatttggctgaagatgtgtttgcctggggaagaagatgtgggcttcaagaatcaatggcaatcaaactgaagaataagacaaatctttgactatgacatatttaaagggcaataataatgctaatagcaaggggaaaagtcccgtagtaggatgttttgctgatacttaacgtgctacagggggagctctatccttgtttctcattggctctgtctgtatgaccaaggttgtcatatgtcctggttatcctgggtcagtccaagtttatgcaggttgtcccagtgcaacttctaatagttcccccttcgactctcgaaagtcccagtctggatgacagttgttactctgtcaataacccataggattgcttcccttaagacctccacttttcttccaaagggatctgccctatagttgtctctgaaggattttgtcagactgatcccagtagtggatttcacactaaagttcaccctgactctgggctgggatgaatggtaaaaggaactctttgaccaggtaatccccctactctttccaggaaatcccggtggggaaaaggaaggtcctatgacctgaacagaagaaacagaatttggtggccagggaaagccttccctgggggtccacccttcctgtgacctgaacagaagaaacagaatttggtggccagggaaaaccttccctgggggtccacccttcctgtgacctgaacagaagaaacagaatttggtggtcagggaaaaccttccctgggggtccacccttcctgtgacctgaacagaagcaacagaatttggtggccagggaaagtgttccctgggggtccacccttcactttgggtgcatgagataagactacattttcctctcaaatatcataataaaaacattaataataagtcctaataatccatgagatgtggagaagtagataaggagttctagagttagacaggctagatttgattccagcactgccctcacggacttgacttcaagcaggttgaccatgtgggacctcatttttctcctctgtaaaatggggataaaaatcttcaacctgggagaggacttgagatatttgtaaagagcagacacttaataggtagtcaataaatggtgatggttagtataatcatcatgacaatgacaattaaaaagcaagatttaatgttttaaaaatgtttcccaacatatttcttctttcgaaggtgggggcagttaatggttttatttctttatcaatttcctcccctggaactttccaccatgaagggtaagctatgaggcttctctgaaaaacaaagagaagattccatttagaacaaaaaaacccagcatgaacatagaaaacccagtgtgggttagaaacacccaaacatttctagggaaactcaacaggagaatttatttctcaaggattttagcattgcatgggaacttcccaggcccttttgtaaagtcctgaatttagcaagatgctggaggcatgtggcactgaaaagaggttaaattagaattgggtaagggaagagttcgggagacatgcccaggacagcccccacactgctgtggcacctgagatcctatatgccgcagcggggacacacgtgctgagagctcttgcagacatgaggtgtctgggatcacaacaaagatcctaccatgttggggactttatgaccagaggctgtggctgtgcacctcagtcacgggtaccaatgggacgcccccaaagaaccatgtgagaccagtcacaccttggccgatgctagcgcaatgctcaaaaccaggtcagaggcccaggccccatacagtgatgtttgtttccatctctacttgggaaagagttggggcatggagtgagggtgggggttatggggagtcatccctttgagagagcaaaggggagatttagattttgccttgaccaaacatgctaaatgagactatttacatacatatacatattttttgaactttgaaagtctttatcacagtattgcatgtgacagaaaattgcagagcctatatgtttaacaagaggcaaatagttaaataaatgttggtacaaccttgaaagaaattactaaaagccattcatattcatatggtataggagacaccttcatataatgacttggaaagaaagcttacagttcgttaactagttaaagaagtgccccagagctctgattggcaggagatagaaatccagtcagagcagctgaagtgagaagataaattataaggtatcttagctcaggctgcctagaagcagagcctgaggcagggtttcttgggcaaatgatgtaatgaggaaacactcttgggaaaaggagctgagggaagcggggcagggcaggggatggtgctaagagaggatgtggtctctaggtgaagacgagcttcagcctgatcccatagggaactctggtgtataaagagctttatagaattgacaccaccttaaggcaaggaggctagccccgcgcacagaagccaggtgatgggtgcaccagcctgggcgaggagatcaaggcttggtaccaacagcatcaactacctaaagatagactacgtagaaaactgagaaaagaactgaagtgcatttgggctctgcaggagtaggcctcctctccttctttctgtatacctgctgtattctcctctcatagaatgactccactgggcccacactagattcatgaactaaaaggcagttcatatacaacttggtgagttatgtgatatggtttggctgtgtccccactgaaatctcaatttgaattgtatctcccagaattcccacatgttgtgggagggacccagggagaggtaattgaatcatgggggctggtctttcccatgccattctcatgatagtgaataggtctcacgagatctgatgggttatcaggggtttctgcttttgcttcttcctcattttatctcttgctgctaccacgtaagaagagccttctgcctcccgccatgattctgaggacttcccagccatgtggaactgttaagtccaattaaacctcttttccttcccagactcaggtatgtctttatcagcagcctgaaaacaggctaatacagtaaattggtaccagtagagtgggctgttgctgaaaagatacccaaaaatggggaagcaactttggaactgggtaacaggcagaggttggaatagtttggagggctcagaagacgacaggaaaatgtgggaaagtttggaacctcctagagacttgttgaatggctttgacaaaaatgctgatagtgatatgaacattaaggtccaggctgagggggtctcagatggagatgaggaacttgttgggaactggagcaaaggtgactcttgttatgttttagcaaagagactggcagcattttgcccctgccctagagatttgtggaacttcgaacttgagagagatgatttagggtatctggcggaagaaatttctaagcagcaaagcattcaaaagttgacttgggtactgttaaaagcattccattttaaaatggaaacagcataaaaattcagaaaatttgcagcctgacaatgtagtagaaaagaaaaacccattttttgaggagaaattcaaaccggctacagaaatttgcataagtagcaaggagcctaatgttaatccccaagaccatggggaaaatgtctccaggccatgtcagagactttcacagcagcccctcccatcgcaggcctggaggtccaggaagaaaaagtggttttgtgggctgggcccagggtctccacgctgtgtgcagcctagggacttggtgtcctgtgttccagccactccagccatggctgaaaggggccaaggtagagctcaggctgtggcttcagagggtggaagccccaagccttgacagcttccacatggtgttgagcctgtgggtgcaaataaatcaagaaatggggtttgggaacctctgcctagatttcagaagatgtgtggaaatgcctggatgccctggcaaaagtttgctgcagtggtggggccctcaaggagaacctctgctagggcagtgcagcagggaaatgtggggttggagcccccacacagagtccctgttggggcactgcctagtggagctgtgagaagagggccactgtgttccagactctagaatggtagcttgcaccgtgcacctggaaaagctgcagacactcaatgccagcctgtgaaagcacccagaagagaggctgtaccctgcaaaaccacaggggcagtgctacccaagaccatgggaaccctcctcttgcatcagcatgacctggatgtgagaccttgagtcaaaggagatcattttggagctctgcgatttgactgtcctactgaatttcagacttgcatgggccctgtaacccctttgttttggccaatttctcccatttggaatggctgtatttactcaatacctgtacctcccctttgtagctaggaagtaactagcttgcttttgattttacaggctcataggtggaagggacttgtctcagatgagactttggactgtggacttttgggttaatattgaaatgaattaagactttgggggattgttgggaaggcatgattggttttgaaatgtgaggacatgagatttggaggggccaggggcagaataacatggtttggctgcgtctctgccaaaatctcaacttcaattgtatctcccagaattcccacgtgttgtgggaggggcccgggggaggtaattgagtcatgggggccagtctttcctgtgctattctcatgatagtgaataagtctcgtgagacctgatgggtttatcaggggtttccgcttttgcttcttcctcattttttctcttgccgccaccatgtaagaagtgcctttcacctcccaccatgattctgaagcctcctcagccatgtgaaatcgtaagtccaattaagtctctttttcttcccagactctggtatgtctgtatcagcagtgtgaaaacgaactaatacattgacttgtccagcatagctggaagggataaattgggtcatctagatcttctcttagcaattatgaattggagaataattattgaaccagctagctatagaagctgaactgaactaaagggacaagaggaagcttggacctggggtggctaccttggtcaatttatgtagtgaagctcaagagaagtagagacagaacaagtgaaataagtggggctgcacacaggtgcctcccctacccagggcctcctttgcttggggtttggtttccacttggcctgggctttggggagtatcaaggaatggctttacacactgactgatgggtgctgagggactccccagatttatctaggctgatattgtgtagtagtaccaaagatattgatggcaattaagataataataaaaatggagatagcaataatgataactcgaagtaaggacttgctgtgtgccaagaacattcttaagcactttacctgtatgttatcatgtcttccttacaacgactccatgaggtaagaactattattatcttcctattatagataaagaacctgagatccagggagatcaatagattctcccaagttcacttggctagttagtattgaagtctgaattgaggtttagccagccagacccaggcatgctatgctatactaaaattatgcaccctcatacacacacatgcatacgaatgggccctggattcacacaactctcgagtcaagctctccttattcttattctactccagcaagcatctcaacctatcttaagctcaattttcaggggaagtccctaacacagtgtctgacactcagtaaacgtatagtagccactcagtagatgtgtcttccttcgtttgattcttcttctcatgtctgagagagtgtttgggcatctacatttacataggggtcagaggtgagcactggtgctttgtccctggctttctactctggcagagagagcacattttaccttcagagaggcaattagaccccagatggcagcactgagcttctgcacagtattggctccccagtggactaggcagaagaacatcacctccaggatccccctcaggtgtgggtgtgacctagttactggatggttgcagagaggacagaccccagttactggatggatgcagagaggacagaccccatgggggagtcagggaaatgagttgagttccagggggctggtagctcccacactcacagagtggagtgttggggatgtcaggagccctcatctctgatctgagcctgtccctcccttctgctctttccctttttcccagccccaccttctcactttaagtctctctatgtctctctttttcactctattgcttttccttccccctcctttccctttgctctttctctctcctatcttccatcctttgcttttctcctttgttcttcccccacatcttgccatctttgctcagctgccctcccctctgactactagcctttgtcttactaattgggatgggcagttccatcccaagctgccctgatttgacccctgactgtgagggctttgatagtccttgagataacagcagcctctgcccaaatgaggtttctgtcttgaacaatcacattgcctgcttggtaatgtggtttcggcttctgtaaaatggggacagagctggtgctggaccaaatccaattccccaacttgactttatacttgaagagtgtgcgtcttccacacaatgtgaaactatatagcaatacgaatgaacaagttataactacacccacagagaggatgttgagtaaaagatgcccagacacaaatttactgaatgattacatttatagggagttagcaaaactgacaagaggcatctatggtgttagcagtcagaatagtggttacccttgggggagtagtgacagaagggattttttttctggggtgctaatcacactccatttcttgacctgggtattggttacatggtggtgttcacttttgaagattcttcaaactattcatttgtgatttgtacagttttctgtatttattatagagaaaacattaaattatttgaaatggaccaaaacataactgggcatttttaatagaaatcaaggtgtctaaaacacctgttgtgtaataaagaatttggctggcctttgctccttgttttggagagggagcctctaatcccttggaatttttggactgttaagaatgtgtttgttattcatggcttgcatctcagacacacctggcttcatgctaatgaggtgactaatggtggtccctagatggtttcaggatgggagctggccacaccagaaagaccaaccatgtgattaagaggttggagcttttagtgaagtgatgtcagtttgacctctggggagtggaggcaggttagagattgagttcagtcacatggtcaatgattcattcaatccatagtgaaatcccagtaaaaattctggacattggcgctcaggtgaactttcctggttggggatgcacatctatgtgctaagaaggtagcacatcctgaggatgtggaaaccttgtgtctgtagccgtcccatacttcacactgtgggtctggtctcttctcttggctggtcctgatttaatcctatgtaataaagctgtaatcataagtatagcactttcctgagttctgtaggctgttccagtgaattattgaatctgaaggaacctctgagtttgtagctagttggtcagaagtgtgggtagactggggactttcaagcttgtggctggtgtcttaaatgaaggcagtcttgtcgaggactgtgtcctttacttgtggagtttgacctgattctaagtacggagagtcagaaatgcattgtggtacccttctgggcaatctgatttgttaaaagaaaacttcaaccaagttaaataagagtttaattgagcaaagaatgattcatgaattgggcagcctcccaagccagagtaggctcagagagtccagcacagccacatggtggaagaagatttatggacaggaaaaggaaagtgacatacagaaaataggagtgaagtcagaaacagccggattcgttacagctcagtgtttccctcatttgaacacggtttaaacaatttaccacatttgattggccaaaactcagtgattggcagaagagcaggctacagtctgtttacaattccatttagattatagttcgcaatgtactgagaaaactttaggctgaccttaaaatatgtaaggaggaggcagctttaggctagatttaacagattctataagggctcagtgacctttaatatctttgagcttttttatacctttgtaagttgtagttaactgaaagcagtgtaaatgatagctgcccatagatgtgcacattttgtctggtgatagagggataatccctcttcagtactcccaaagccagttgtatatctatttgtaaattcatttcagcatgaactgaatcaactataaaagtgtgatactttgagttatcttttgaacccatcataacatcttactgattccatagttaataggttaaatatcttcagcatattttcattttatatttgcataagagtcatgattgtcttttaaagtttaataatgttttatacttcaataattttttttaaaatatgcattttcccaggccctatatgagccatactgatccatcatttctgggattggggctacaggaatctgcattataataaattttctcagtgattctgatgctattactcatggcctaataattgaaactctgcactagacaatagccaaggctccctgtggcttcggcacatcaggatttgagagcagatttgaacctccaaggttatcatttgacgccatttatcttcatcctgtttggggttttcattcataaaggagttcctggccaggatttgcaaaagaaaataaaggttacacccttgcaaagcggtgtttggaaagccttctagccaagacttttccttcattctgttctggagtccaaccaaagaggctaacaaagaatcaggcagggctgggctgtgactcaggccaaggtagacagaagctgaagagcccccacttacttctatgccactttcttattaagctgcagccttggttttgcaatggaattattttttttttgtctttcttccttcaatttctaatgcaaacagcaatcctcagaaaagcaacatttattaaatcaggagaattacaatatcaatgggaagttatcatgcaataaccttctattgatttgtgtattgccagtaatgaaatcaactggaatattatttattaaacatattgattagcaaaaaataatttgcaaggatggaagcctgactctacaggggatcccactgagttttgagtgtgtatctgcaattttttccttttgcttggggaagagctgtagtgagtatctgacccaatacagagctagccccaagatgcagtgtccttgagagcatccactggggaagggcagatttgtagcctgttgggcctggacatttgtatgattggccagaaagggcccagaacagactgccattgtttctctaccaaagacaggatgaagtactgactgggtagagttgtttctcactcctgcttatcccagggagagagtggtggctgggaagtggggaaaagtacaaaggggcaatatcttggtttaggttctcccaaaagcagacactgaggtaagatttgggggcaggtggtttgtttgggagatgatcctgggaagtacagggaatgaggggatggggaaggtggagtgtgtcatcagtgagtgtgtcattgaccgggtagcactttgggcaactggggctcagttctgctggggaccctctgaacatatgtttgacatatatcataaatgctcaccaagggacaaagaagctgaggcattttccactagctcctgcctctcattgattgagacacattcctctttatcttaaccctctggcatctcttgtattcctgggctatcacacacattggctgagcatgttattcaggaagtgcgtagctatatgtagaaagatacaggtgcttgaggaggaaccttcttaatggatgagaatggtccactgcagctgtaggatctttgcggccaaggggatgtgggaggtgcctgacagtatgtgccacagacacaccaagcatcagtctcagggcaggttttccttgcagccatctttgatttttaactcttcctcacaggttccctgcaatcttgaatcctttctcttctttgaacagtatcttgaattttcacagaggagcagcagtatgaaaataaaaacacttctgagtgcttactaaatgcagttgatctcattcattctttacaatgaagaatgtagatgaagccactgttatctgtgttttgcagatgaggaacctgagaacacaagaacatgcagggtagagaatgagagatctggaagtcaagccagtttgtctgactccaaagtgcatgatttggttctgagtagaatgattctgagcatgggatcttgggatagatttcctggaatggtatcttggcttcattcctattagttttgtgagcttaaataaagaacttaacctctctgatcaccagtttcttcatctgctgtggggataacaaaacctgctgctccacaggcaatagtgaggattaaatgacatcatggacttggttattacatagtaattttagttaaaattcatgtatgtatcatcaccgttacccatcactgaacttcatggctgctgtactgtgcctcacctgtttgctctgattcatcccttatccttccttgctcctttctgtgtcatagggaggctgacacctgcagctgccttttccagactcccacatttacgggtttctggctgggcttagccaataggaggtgctgatgggaaattagagggttggaggaagagagaggccagggtacttctccccctctgcatcttaaggtggtagcagctatgcttctttgatggctcctgttgttatgggacactttctatgcatgagcatggcccctggctcctagtaaccccacctcctccctctgtctctgggtggtagcagcttcctgctattgttaatctctgggtttcctctctgtttggtttctcagtcctttcatcaccattacagccaatttcctgggataaaccctctttgcttgtggcttattttccttttttagattctgataaaagcacttttaatatgatagtgtcatttccatgtctgaaataattttacagttctgctgctgagatccttgtgctagacacacaaactttggacaaggcagggatgggaagaaataggatcaaggtgattgaagaaaagaagtcctaacaattatggagaatctgttacatattgtactgtttacaccttatttcaggcttggcttatttcatctttacactgtaaaactatacaactggcattactgcacccattttatggatagacaaaataagatgctcaagaaagattaaagagccatgttagcagtaggtctttgctggaggtgataccaagggaattccaatgatactcatctaaattcaaagacactccctactacctctcaaggagaggagaccttcctctccaccagcattcacaatgacaaaaaaaaaagaaagaaaagtttctgactctggttagatcaacaatagctgatgggtaattaggctgaaaaaaattgctggcacctcccaaattgacctggtgataaggacgaaagcacggcagtacttgggagtacagccctgaaaggttaatgccacactctgacatgtggatgttgttctcctggccagatattcacatgggtggcaaactcccattggtgcacccaggatttgacagagatgtactcacacttaaacaatatgtgacctaagtggacaccctactggatgtcagcagaggggcagctggctcactatgggttccagcatagagaaagagggttggcctattcccagggcagtggtttgagaatgtggtggctgtagaacatgtgtcaaatccggaggtggagtctttatccctccccttgaatgtggactggctttagtcattcacttataatgaacagcatcctacggaattgatgctctgggcttccaagcctgggtcataaaagatatacagctttgggtgggcatggtggctcacacttgtaatcccagtactttaggaggctggggcaggcagatcacgaagtcaggagttcgagaccagcctgaccaatattatgaaaccccatctctactaaaaatacaaaaaattagccgagcatggtggtgcacacctgtaatcccagctactcgggaggctgaggcaggagaatcacttgaatctgggaggtggaggttgcagtgagccaagattataccactgcactccagcctgggcaacagagtgagactccatctcaaaaaaaaaaaaaaaaaaaaaaaaaaaaaaaaaaaaaaaagaaagaaagaaaaagatatacagcttccacctggccctctctcaagacacaacccttgatgccttggacctctatgtaagaaatccggctgccctgaagctgccatctaaagggaccttttggggagatcatgtagatatagagatgcccaaggaaccccagctgtcccagagcccagccatttgagtcttcccagtctgggcacctgccatgagtgagtagaccttcagctgtttctagctccctgagagagggcagggactggggcaggaacagtgagaaggagcaacagtgctgagccagccatagaggagcctggggcaaaaggaaacaccagtaatgctgaccctgtctttaaaattttgatgttttgttcacagatgttttgcattagttttgatttttaaaaagtatcagttgaaatattatttatctcaatgactgagtttttttggcatccctttaaaatgtgtgcccaaggtgagtgcctcatttgcctcatcttagtccttgcctgtgagagaccttaagcaagagctgcctggctgatccaagtcggtgcccagaagacacaagggccataatgacattggactgattcattttgcagcaatagctgcatacaaagaataatcatggtcagtttgcctggatttaaatactgactccactaccagttagctggtgtcactggacatgctggctaaccttgccaagcttcaatttcatcatctgcaaaatgggcacaataacagtactctcttcatgggattgttgcgagaatgaaatgtaaatgttccatgcgaagcattaaacacactgccttgcatacagagagtgctcagtaaatgttagctatcattatttttgtttttgctgccattgttacatagcagttggagaacctgggagagctctgcctggataatttcatggggccaatgtccttccattatgctgcattgtaccatcgaggataattgctctctgagctatatttccattaccaggtgccatatcacagcaatgttttatattatatcattttattttatttttgtgaggcagggtctctgctgcccaggctggagtgcagcagtatgaacacagctcactgtagcctccactttctgggcccaagcagtcctcccacctcagcctcccaagtagctgagaccacaggtgtgtgccaccacccttggctaaattttttaattttttgtacagacaaggtctcactatgttgccctggctggtcttgaactcctgggctcaagggatcctctccccttggcctcccaaagtgttgggattacaggcatgaatcatcatgcctggccttactgcagtattttaaacctagattggaaaattagcaattaaaagtgttaaatatagaactatcaaatagatggactaaagacatatcaagctcttggtaagaacaacagtcttggactgacaacctctgagttaaaggacagccgtgttttcagaatgagagcacaactagataattgattggttcatcctcttccctctggctggtgttgcattttggttgtaaatatgcacgaagtgtgtgcatgtgaatgtgggactggagggaaaccatgagtatctaattaggcatgtttatatgtgacctgtgtgcttatgtgtgtgcgtgtgtgtctgtgtgtgtgcatgcatgtgtctgcgtgtctctgtgtttctacatatgggtctgtgtgtatatgtgtgtgtgcctgtgtatatctgtgtgtatgtgtgttgtgtgtctgaaggtaaactccaagaaggcaggggccatgtacttagcatagtcactggtacagaataaacactcactatttgttaaatgaatgaatgaatgtgtatgcgtgtctgtgtgtgtgtgtgtgcatgcatgtccatatgtgagtgcgggtgtttgggtttctgagagtggggttattaatgcttgagtgggtgtgagggtcctacatctgattatgtgtttaggtttctgtaagtctagaacttgaccatgcagagacaatgaattttcttgcactcctctgacccctacctgtgctcccactcatcttccttagggctccccttgcctggggagctaccctcctcaccagcctgtagccagcccccatttggacctttacttctgtgtgtcttccggaggacacagatggcaggagcacggaatcggaagcacttggcaatgaagcagcaattcattccgcaatcccttcgtattcatcgcaacaatgcctgctctgatgggctccgcgcgctgaatgcagctttcaatgtgcaatccagcgggaattgtggtgctttgtggtcctcatcacgtccacttattgtcaagtgttgctgagaattctcccactcgggatgagggaaccacttgttttagcaactgatttccgaaaccttctctgggttggggtatctgcgaagctcctggtgatgtgttattgttcctggtttgtgttttggacactcatgtgctctgctgaagtatgtaaattgccataatgtgaggaaatgtgatataaaaataactccggggcaacaaacaccagaggagctccaagattggcacagcctttcctggtcctgccttggggctagggagcatctcttgccggcagtgttggcagcaaaggcctgagatgccctggaatgaccactgcccatcctcctgcagctgcccagctggcctgctggagaagggcgggtgagacccctcctaggaaggcaggaacagctggatgtggaccgtctccttttttcgcagctggtcaacagaaccacaggctttgctctggctaaagggaatctgccacccctgactattcaggtggctgcacacactcaggggcaaattcacattcattgttggccgcccacagcccgttcatcttgccagcagggggctgtttcccaggatcccaggtcaggtggcttcagctgggatccactgggaagcattgatggggagtggaggacagcggaggggaggatggagacaggaggagctgggaaagtctctgtttccctctcctctctgactcagataatgtcttcaggagcagctggtctcctctgtggatccagaccctaaaggtgacctcctgtggtcttagcttctggcagaagacccttgctcctggtcatcccatctctcctctgaccctctggcctagcggtggtggtgatctcctgctgttgtttatctctgggttgactcactggcccttgtttggcctctcagctcttccattacccatgtgacagattcctggcatcgaagtccctctgttttaagtgttcagtagtttctttttcttgtttagactctgatacttcatcaaggacgtcttggactaccagatcttcctccatggcctgtcgaggaaatgaatcaaaaggcaaaccaggcacaagggaaacaggccatttttctacaaggatggaactgaaggggaattaacagcaataacaaaaatatctaacatttactaagttccacatgttggtcactgtgctcagcactttatacttattatcttatttaatacagtaaccatttgaggtggatattactattattctattctatatgagaaagctgaggcttacagaagtgaggctgatatatctaacagagtgtgcacgcaatggtcaggatttgaatctagcagctttatcccaggactcaggctgcaggacacagtgtgcttctccttttttagtagcacctttcaagctgtagctggtggtgctgtagttccacttgatgttacacaggcaataacaacaaagggttctacagtgcactgaaattggggacatggcatgttctatccccaccctatcttggaggtttgcaatgcatattgacatattaaaggctctgataagtcctgcaggaaagaagcacctctagttcagtgaaccccaagtgttcccctgtggaattctcgtgttactcttgttagcatcctttaggggttggtggtccagggacgtcattttggaaaatagtgccctagagaggggactcatcttgagaatatcatattttatatatatagttgtatttaatattttaagatgaattatctgaaaaatcgactggggacagaggtcttaacattgcagattgagaaaatgccttaggaatgattgcttctaatgcctttcccacttcctgaattattctctcctgtcccatcaaagtgttcgtgggctttgcctggactctcccaggactgaagcatcctccctccaaagccttgcaagctattgttggatgtcttggaggctgaaagacattcaccttcctgtaactctcatccatggactttgcttcttttctcacggggcagttcactgacttttagaatgtattcatcatgtccaccttctgtcttgcattttccagcctaatctgtttctgttccctggtgggtttgcacaccctccagggtgccctcctccttggaggctggtgccctgtgttgaaccagcagaattagggtgtgccagctatatgcagaggtgagaatagaactcctgccttttaaactttctgtatctactaatattaataacattcatattgtaaatgctgtcttctggccaccagatcagagttttcaatgagattgaatctatatagtcagcccaagctttgacatgtcctatatattatttttaatttcacagaagctgctgtttgtgtctccctcatcctatgcttctgcagatgattttgagatcctattgcaggacttagcaaatgtctctatcaaatgttatttcattagtttgacgctttatctctgttttctcttgcatctcattcacatccacagtctacattttcatccacatcgttgataaaaatgttggataggataaagtcaaccatagtgacctgggactcaccaacagaccttgacactggtctactagacaacgacttgcttattaagccctgtcataggcattcccacatttctactttcctttgattaaactgatgctcaggtatgtaaaataaaatgtacaatgagaatgcacttgtggcaggactggtacctaaagcccatgctcagtccaagaaagtttgccattcttcaatagaaatgtgctctgccttccaaccaaggctattgggaaaacatggtctgaaaacgttttgcaggatatggcagagttacccctgggtagtacaatggtggccagggcttcctaagtcacactgggctgtgtaacatgatggtgctcccagcatcctcacatccccatctttgcagatggtgatgacgtggttcccccagcatctccgacacccttcaatgaagcagtcttcattgcctcacagacccgcctgcctgagttttctacctggcctgccccattctcaacaggacagaagagcagagggtcataggtcacaccagcactaggaggttcccatgaacacctcctggatgactcattagcatattaatgcacagcctgtctcctgagaattaaacaaagttaggggtcatttaattggaaatctaaaggacagcacctaccacaatctgtccagaatttatgcacgtctgtcttgatgaacttggagggaatggatgattcacaatgggccacctgccttctgatttataacccatcatttacatgttactaaagtcaattggcacgtgcagaaggtcatcctcaactagaattaggctcactaaatctctgggggcctggtgttctagtcaagttgtgccccaatcatagggcctaggcttctatggccagaggaaatgacgaaagacctgggccaaagagtcttgggaaggacagtgtccaaccccagggagccctggcctcctggtggactgtactactcagtagattgtagactctaggtcattgttaagagcatgagatctagagtgagactgtttactttctagccctctaactttgaggaagccacctaacctttcttagctttggttttttgtctataaatggcaataataaaagtaacaacatcacagggttgtgaaaattaaaatgagctacattaaatatttaggaaagggcctagtatatgaggatgcttgctcagtgttggttatgagattctagtagttgagtggcccatttgtggaatcaagacgacttgtattcaaatcctggttctgttatttaatagctgtatgacccagtgaaatgtacttacagtctctcagtctttatgttttcataagtagtctgaagatgaagtaggtaataatgcacctaattctcagggcggtggtgagtttgagttaaagggggctatttaggtaaaacactcagcagtgtgtttttcaaatagccctgctgctctttaaaggttagcaatgtgaaagaaggttgtggtaagtctcgatttggactaccgcctgtctgaccagatcttgtttcatagtttgtcatgcatgagctgcgagctggcctgttgttctctcctcatgtattttaaatgtatttgtaatattttgttcttaaaaaataataattgtatgtttttatggggcacagtgtgatgttttgatagtgtatatattgtggaatgattgacaacagccacatttctcacctacaggatcaaagattccttgttctttcttgacttgctttcataaatatctatagctcttgttttttttttaaattttattatttttatactttaagttttagggtacaagtacacaacacttgtttttacttcttcaggctttccccattttgcctctccgaaattccctactcagaatctacctttagcccacgaacatatcaactctcctttgactaaataattgggattttttcttcccttgtctactttgaatttgaaacatccaagtgctggcaaatggattctttccatggtagaagcagcactgacattcatagccaggcttcactctcacctgtgttcagggcatggagtctgtgagtttgagtaacagcctgcagcccctgctcatagcacggagatctctgttctattgattgataaccctggtcagagccttagtgaccacctgctctgaccattgggcagcaggaccatggctgaattagcagccatccaaggcacatacagagtggacctactcaggaaacttgtgctgagtggagaaaatgatgaacagagttacaaaaattagagggtatgtttccttcttccttccttctcttaaagagagttaataagtggtgcctttcttgaggtaaaacacatagaatcaacattttccttatcaacatgttattttcaacatttaaagtaatctcagtgggttgatattttttggaaaagttagttgacttatttccagtgaattttcctgagttttcattattaaaaaaacataaactactcgtgatgcattttataatcaattcattgtaatagctaatatgtattgattgccttctctatgtcaaatcccaggcttggtgcttcatgtaccaatcccctgccatcctcccaaaggccctgagacttaggtatttgtattatggtaattgctccagctgtcccaacatacaaactgtgaaatctcagtggcttaatgtgattaagttgtatttctcactcttagtttgatggggttgggtgggctctctgttgcagttacaacatctgcaacgtgtggcccccagggtcactatgataaagggagggaggaaatgagacttttattgggtgtgtttaaaagtcaggcctcgaagcgactgacatcacttccacccatatcccattgaccagaactcagtccatggcccaacccaagtgcaaggggggctgggaaagatacaagactacgtggacatttgatagtcgctagcactattcactacatgtcatttctatttaatcaacaaaaaccagaagttcataaagttaaataaattgctccaagtcatacatagtaagaggaagagccagcaattggaatcagatctcctgacctcgaagcctatgctaccccaacttttgttcaccccatctttcgtgagttctgtcctttagagagaaaagatacatatctttggatgctagagaggtctggatatggggtcagcttcacactccatccatctgcagccgaggggagctgagagaagggataaggtccattccttatttaaatgctatgcaatccaaggcaagcagcttaactactccaaggctcgatttcctatctacaaagggtaggaactaatcatactgccacagacagaattctaagatggcatccaagatttatgtttgctgttgaacattcccgatataatctccttcccatgagtgtgggcaggatccatgaatgtgatggagttatgctacattatatggcaaaggagattttatagataaaactatggtccctgatcatttttgactctgagttaataaaaaaagattatcctgggtggtcctgacctaatcaggtgagtccttaaaaataataagaaaatgcagtagatgctcttttgctggcctagaaaaaagcgaaaagccatgttataaattgcctgtgaaggtcacattgctaggacctgagggtagctcctaaaagctaaaagggaccctagctgacagccaacaagaaaacatgatctcaggcatactaaaagaaactggatgctataaacaacttgaatgagtttggaagaggaccctgagctgcagatgagaccacagcctagctaacctgtgcctggacttctgatccacagaactcctaaagtaaatttatgttgttttaagctgccaaatttgtgctaattgactatgtagcaatagaaaccaacacacatacccatcttggagtgttgttgggagggttaattaagacaacacatgctacctctcctaatacaaggcttggcacattgtaggcatcaaaaatagcctgatgaactgagtcaaatttcccaggatttaaggtgtccagaagtttgactcttgcttctctgaggacagttcttcctttggctatggttggtatgaggggaacttgcacattcactatcttaggtcaagttccctagaagcagagcctgtgcatgtgatgagttgagggagggccttccagaagaactcatgatgaggtgagagaagcaggatgggctggggaagaagctagatcaagttgtgtgtttagctggagactagcctcagcctgagcacatggggagcccgggaccatgaatggcaccacaggctttgcctacctcagggcatggggttgggctcttgtattccaccatcaatcagttatgggctggggacctcccctagtgggtgaaggagggagctaactcccaagcatttccagggcgataagtagtgcccacccaggacaattctccaaagaatggggcagctatgagctgcttgcggtgaggcagtacctggtaaaggggatctgagtggggcaccgactgtatttgctacattctccttttctgctggtcaatgtgttgatctctcaggttctattctcagtcctttacctacctttcagcctcatagacttgaagatcccggttcaagccttttctgtgattatttggatctttcaagggtctccacagactctcatctccatcgttacacacagactccagccagctcagctctgatgtcatgcccacgccacctccagtaccccagcaccctgggtgccggctcctttaagccatgctgctagattaagtacttaaatatttgtggcccctgttatgtgccaggtactgtgctgggggtgggtgggaggaaataagggtatattaagaagaagacctttcccagagtttacattctagtaagaaagagactcatgaaagaatcaattatacaactgtggatggcgtgtagtggacacctcttgtgcctagtgtcctagcaatcttctcactgccaccctatacccccagtgcctttcactccatccattggtatgtaccagctgtgtgcaggtgtagcatgatagccccttgtctcagctgagcctcttgctgtctaccatgagtctttcctcctgtcactgctgcatgggagacctgcatgaagcctctcaataatttggacgcttgggaatttttggaagagcagaaatttaacactccatgaagcacttttggccaccaggggaccggggccctcattttcataccttgggtggaaattttgaaaagccttctctatagctacttagggcatctctgcaggattgagtcccagttgctcatagctcggtaacatattattgaatgggctttaccctcttcttgtttcattcttcccagtaccttctaccactccttgagatcacctcccaaataagctacctgcactcaagcctctgtctcaggcattgccttcaggggtaactcaggatatggcaggagctcttagggcacctaacatgccacctgccatgagcccaacggtagatagaaaggatttttctttaaaatcaatacaaaatattttacatatttatggggtacgtgtgagtatttgttacatgcacaaaatgtgtaatgatcaagtcagggtatttgagttatccatcaccttgagtatttattgtttccatgtgttggggacatttcaagtcctctcttatagctactttgaattatacaatacattgaggctaactatagtcacccagtctgctacagaatagtgggcttatttcttctaactgtatgtttgtacctattattgaacccctctttagccctaccttacaccacacacttcccggtcactgatatctatcattccactatctatcttcatgaggtcaagttttgtgtgtgtgtgtgtgtgtgtgtgtgtgtgtttgttgttgtggtttgttttttttttttttttttttttttttttgagatgaagtcttgctcttgtcccccaggctggagtacaatggtgtgatctcggctcactgcaacctctgcctcccaggttcaagcgattctcctgcctcagcctcccgtgtagctgggattataggcgcctgccaccaagcctggctaatttttgtatttttagtagagacggggtttcactatgttggccaggctggtctcaaactcctgacctcaggtgatccacctgccttggccttccaaagtgctgggattacaggcgtgagccaccgcacctggccatgagatcaagttttttttaactcccacatataaatgagaacagatggtatttgtctatctgtgtctggctaatttcatgaaacataatgacctccagttccatccacgttgctgcaaatgacatgattttattcttttatgtggccaaatagtattccattgtgcatatgtgacacattttctttatcccttcttccaaggatggacacttaggttgattccatatctttgctattatgaataatgctgcaataacatgggaatgcaagtatccatttgatacaccaatttcttttccttggtataaataccaaatagggaattgctggaacacatggtagttctatttttaattttcttgagaaatctccatactgtttttcatagtgggtgtacacatttacaggccacctaactaaactattaaccaagctgagaactgagagctggcataaagcggtgaatgggacagcgttctaggttgaggatcccttggctccttctgcacctggtgatctatttgttcctttgcgacctaatattatctgttccttacaggatccttggatgtaacagacatttggtcttctattatgacactttccaaaatatattgcagcagttctgaaaccttagtgtacataagaaccatctggagaattaattaaaaggattttcggctcctctattggatatctatcgctgcttagcaaattatccccaaatttagtagcttaaaacaacacacacgtattatcttacagtttttgtgtaacaggaagcaaagcatgacttcacggtctcaggatctctcacaaggctttagtcaaggtgttggctgtggctggggtctcatctgaagactcgattggggaaggatctgtttctaagcttattcatgtggttaatggcaggattcacagttcttcaccacatgggcctctctatagggcaatgcaacatcttgtttcatcagaacagagatgcaagaacagacagtgaggtggaagagtaagatgaaagtcagtcctttgtaacctaatcataggagtgtcatctcctcacttttgctgtattctatttgtcagaagcaagtttctaggtcctgcccatacttaagaggaggagattgaattctaggccaggatcactgggagtcattttagaaggcagccttccataggccccacttgtaaagccgcagattcaggaagtctggaataaggcccaagaatctgcactttttagtaaacacactagattggtggttattaagctctgttgcatattagaattacttagggactgggcacagtggcttatgcctgtaatcccagcactttgagaggctgaggtgggcggatcacctgaggtcaggcgttcaagaacagcctggacaaaatggtgaaaccccatctctactaaaaatacaaaaattagccaggtatggtagcacacgcctgtagtcccagctacttcagaggctgaagcaggagaatcgcttgagcccgggaggcggaggttgcagtgagccaagattgcgccactgcactccagctgggcaacagagcaaaactctgtctaaaaaaaaaaaaaaaaaaaaaaaaaaaaaacttagggaacttagaaacatccagtgcctcagctgtacccagaccaattaaatcagagtctctggtggggtgagtgcggtgtgtggagtctggatatccatactttttaaaggtctctacatgattctaatgtgcagctaagtttgagagttctggtggtctgttacattgctagcactcaataaactatgcgtcctggtattcatgtcctttcttttaatcagggctgggctgtgacttgctttggtccattgagtgcagtagaagtgacactgtgcctaagtcttaagaagtgcctggcaccttccacttttggactcttgggagctctgagaccccatgtaagaactcctacatcctctagagagagactggaaaagaccatgtggagagggagagcctgcaactgtatggttgttgttcaagccattacgttttgagggtgatttttcagcaatttctgtttcagttacctattttacttattcttccaactctaccatctggctggacttggtgaagcagtttttgaaggtggtcacttgtgtggctacattcagcaggggggatgtttggggctggctcagctgggatgctgggacagctgggcctggctttctctccatgtggtctcagagctctctgagtgcagaagcagaagctgtttggtctcatgaagacctgaaaccagcactgtatcacttttcatggaaggtggcttgctgggggccccaacacacagataccacaaaaatcagtgcttctcaaactttcatgtgaaacagatcccctggggactaggttaaaaagaggaatctgattaggtaggtctggggtggggccagagaacctgcatttctaatgagttcctgagtgatgctaatgctgctggttcatgggccacattttgagaatcaagaggctagaagatttcgttattggtgccccttgagagatacagagttctattgtaattatcttttcatacgtttattattgatccagggatgcttaaacatctttagtttatggaccccctagacacagggagtattgcagtaagtttagagtttacagacttaccccatcacctgccaggaagccttctatgaacccctgcaagtaaagaatccctaccctggactgggaactcctagatctgtgttattatttggccatgacaaacagtaggagcttaatatatgtttgctaaaaataaatggatgaatgattggctatagatatggtatatggtgtatatgatataattatatatacataatttatctcaatttgacttagaagggccttactgctaactaaccaccggagcaaattggcctaaaccctctcatgtccctgacaaactgtcagtgaaggtagggtgatcaactgtccagtttgcctgggactaagggcttttctggacataggacatttagtgctaaatctgagacagtcccaggtaaaccaggatgagttcaccctgaatgaaggtgaaggtaaaggtactctgagctcccctaagagccaggcatcagagacactgactcttgccctcatggctggcattttctgccacatcagcactgttcgtacatttcaaaagcccatctgtgcccgcaaaggagtgacttcctgtgtgcatgggcggccctgggaggctgggtctctgagagcccgttttggattataagcctttgaagacatctgcagggaagggataattcattccagaaaaacagctctctttgccatgcaaaccagagaccaggaatggaaatgaggtttttaatcacatggggcattttcagagccacctgctggctctggcatctagctgagttgcttcatgtagaggtgctgggagcgggtctggcctctgaggtcgggctgctgggaggcctcctgggtcaaggcatgagctgctgccttcaaagtcctcttgcagctgcatccagctgggcctgcagggaactgatgccaggaaaggtccgctctgagcttagcaatgatgccctcctgctgctcggaaagtcctggacgcaggacctgtcttatattttgtctctcaatgttcatgagctcctgttctatgccggtctcctcagccctgggctgggggagcaatcggaggctgaacactgtcaattgaggggcttaccagaagcacctgctcccacctcctttcctggcagactcactcatgctgtacatttgttagatctaggttgaaatctcagttcccctgtttcttgggttaggttccccagaaggagatgcttgttcgggatcaacacttgtgaaaggcaggaggaatagcaggtttgggcagaaggaaaagtcaaattgtgatacaggtccaacaaagcctgggccaaccagaagaaagccctgggatgaatatcaatcatcagagtcatcctagggtaagctcctaaggctgggcttttacaattttgctttgctctgttattggcttctctataaaggacatgacttcaggggaggtgaccctcagaagctgagacagaggctgaaggaggtcattgctgaagtctgtttcttgattgagcctcctgcagataggtataagcaattaactgaaaggagttctgtgcagcacactttggtatctactataccttgcttataaactgtttgattttaggaatgtaatttacttttctgagcctcagttttcatgtgcataattggggctactagctataaataactaataactttttttaaagaaacttcattctaataaaatatttcaaacatacaaaacttatacaaaagaaatgagtttagaatcgtgaacttccatgtaccagtcacccagcttcaacaattaccaactcatggtcgcttttgttccaactataccccaccataactactggattgttaggaagcaaatatcagattcagaaatattgtatttcatccaatagtatttcaaatgcatctctagaagggcttaaaaataaccaaacataaccacaatatgcctaactgtttttggcagattaaatgatctagtttaaatggagcatatatgacagcatttggcacacaacagggatttagaaatgtcagctatgtcaaaacacatcctcttgggaaatgacacatgaaagaagggggaaagaagcttaattttatggagtgtagagtgtcaaatatgtggcacagacactaccttcttccacccttttccctcaacagacatcactattcaatcatggagctactctgctgcacagtgttccaggcagccactgtccattcagtggcagagattaaaagatgaaatcagtttattcacattgtcctagcagactgatgaacagttctcatctggaacaatggcttaacacagagccaggcttgctgccctgcagaatatctgacaactaccatccagctgcatggttctgagtccgggctgggtcactgtgatgtacaccagctgctcatagaccacttttgccatttccagtgtagggagggagactatgcagctttcacccagggaaaattggtgagaagaagcagacctcagacccttgagagccgttcaagcctgacatttcaacatctgcccctagagcactgtcttctcattcttgctttcttctacttcagtgtctgccagctactttttggggttccttccccaggcagttatatgcttcttcttcatctcctccagccttcctcactttgttacaccctctctgaataatgttgtcatgtctccagtggacaaaagtgttgggggaaaaggagtgtatgtgtgggtgtgtgaaataacccttaatacatgtacatgattccatagtgtaccctgtactctctgttagttgtcatcattcttatgtaacactgaaacccaaaggaactcatcatattttcttctatgttaaacttcttagatcaccaggtcaaagggacagattgggtgtcctgactctgactcacattgatgcatcacagtcctggaaaatccttgagctgtggaactctttctttaaatgtaactttatgttattgtccactgtccaacattgtgggtgaattgaggtgggggaacatggtgtactgtctaccattaaagtgtggtagggaaaaagagaaggttggtttgtggaatcactaggactttggggagcccaatttaaacaccatcacattctacaagcagacacagggtataattttactagcctggagtataattctgctcttgacagaatgtctgggaatcactggttatgagattctgtattttcaaacccgcatttataccctataaaaatgtggggtttactacgtgctggaagcagctattaggataaattgtgctagctcctgaaaccaggcataagccattcctacacctgccaggactgtcctgtcttcatcatacctagcttaagccaatacaagaatgaagggaggaggaatctgagccttggttggccctaagccttcacccaaatgatcctgaaaataattgtagtgatagtaacaacagcaaatcttgaatatttgctctctctgtgttaagcacaatgctaaacacacatacaatttaatgcccaaaactctaggtaagtatttttatcttgtctttagaaactcagggatgctcagggctaacaggtgacaagtgattaaggcaggggttcagatcgaggtctccccaattctagttctcacattgtcacttgtccatcctgattccttagcctgatgcttccatgtaatcttatgatggtcttcaggaagggtgtctttccttccttgtgctcaaggtcacccacctaggaagggaacatgcatgaacacaggtgcatctgagtccaaattatgagctttgctgctttttgagaggcgggtagtacaatgggcaggatgtattgcttctgagaaaaattacctttatgtgggggctctggttcataccccaaaggcaggtaagaacagactgcttctagaagcagaagtaacctgtatcctgccatttttatttatgggaaaatagttttatttatttagtaaaaatatgcaggatgaacaaaattttgtttctatgtttttgtagactaacaatatgaatagtcctctgacaagactggacacgggaaaaagaaggtagaaataaaaattttttcctaccgctaaagaagagaatctcaattatgaaaaagatggcaaaatgtgggaatgaatgggagctcatgaggccagggaggagacaatacagtggataagtaggtgcattatctcagattgcatgcctgttacaaagacttggttcataaagtgatgaacatcagtcaccccagagattttcagtttatcccagcccagcacattcgttaatgtatagtgtctagaatatattaaatgcttgtacatatcaggcccatgctaggaactttgtatccattactttaaaaaatacctttttattttggagcaattttagagttacagaaaacttgcaaagatagtacagagagttcttgtatgaactttgtccaggttcccttagtgttaacatcttacataacccaggtatatttgtctaaactaaggaattaatgaaggtacactattattaagtaaactttagattttttttggatttcatcagcttccccgctaatgtcctctgttttcttgttctgggatctaatccaggataccacattgcctttagttgtcatatctccttagtctcctttggtctcattatttttttaaatcctcaaataattgttcctttttagagatgagaaacaggctcaaacatattaagtgattttcattggttcacaaatctagtcagttgctcagctgggatttactcagctctgtctgattgcaaagaccatgcatgcattttctaaccactgtttactatgctgccgcatgagctgcctatatgagaatcctgaacaaccaagaaatgaggaaactaagagtaccctgagttttggttagtttagagcaattgccacctagagggtgaatgaatcctaagttcacatttccagcccagacttttgctttacaccccggagcatagatggagatggggtgagaagctgcacattggcccaattggccaagtttacccatttggccaagtttacccatttcgctatcttttgaatgccccataagcatctcaaactcagcatgtctgaaaccagattcgcctttcttctcaaatctggtattctggttctttccttcccaaacttggctcatgatgatgtaaaaatggagaaatggctataagcagtcaccagaacttaaagtcatgcggagtaattccagagcagagagagcacatgttgagtggagagagagaatcagtgacttcttagtgaggggggaataaattagacatgtgatgactggttgaagcgtgctcagtggctaggagtagtccctgaggaggaggcaattcccaatcttcttgctgccctgagttccctcttaacttcaatttctgtatctgcaagactgcccaactctactatagttgctgttgtccccgagcacaggttcttgagttttccttagctcacttaccatacatctctattacttagaaaatatctagatagactgagactctcagttctgattacccaaaaaacccaaaccaaatcttccttcccccacagagctgcagaagtggtgtggctccagcttctctagaggatgcacagagggtcttagtccagaattccactgaatctgtctacttgatcctacctccctgcaccctctcaggatggagaagtggaaagcacaagatacacctgggtttgaagcctagagctgccatatcctagtcatatggccttaaacaagtttcttattctcctatggtatcagtttttctctttatagaatgtggataacgatatcttgcttagcattgacttgagaatttaagacaatgggtaggtggcaactgagagaaagactttcttcctctctctttctcatctgtcttttccatactttttgaaaatcttatattcttagtgtgaaatctttcccctgcttctctttctgcttcccacatgaggactgttagatttgatgaattcttgaataattcattcataagcaaccaaactctttgataaacagcttgggattgagggaagctactgggggaacacatgcaccaagaacaacagttttattttggtccctgctaaggtgagtgagggacacaaactgaaagctgggatgagattgcacagcatcatagagtggctttggagaggctatggccatggataggcagagagagaagagagaagaggcaactggcaggagaaaggaacaaggtacagtggaactgggacagtgggcagaagaacaggggatttattcaagtttctccggtctggtgagcaatgtgaagctttcttttcatttccttaggacatctttagtacaataccatttttgcactaacatctgtgtatctgaatccttgaaggggtatctgataaagtgctaagtgtaacttcaaggtgagatggggtgaaaaccaagggcaccctaagaaggcccatcatgtctggatttcattccagtgcttggcatggagtaagtgctcagtaaatactagtgttaatagtggctacagttgtaatttctttccagctcctttttctcttctacactaagatcttcaagagctcaggaaaatgcacctgttttattcacttctggattcttaccattggcagagtgcctggcccatagttgggttccaataaatatttgtttttatgactaacaaatccatgtaatctctgtgaccagctaagttctcttctcagctttattgtgttttcattcaatactccccatcctcagaaagctgattcattctgggacttcagctcttacatccatctagtggattactaaatttgtatatccattcccggctcacatggataaggctggcttacatggataaatactggaattgacagtatttgattatttttaacttacaaaaacaacaatttcataaattgtaatctaatattcccttaaacttccactcaaatgttatattgtcaccttcaacacaacataggtgttgtgcacttctctgcctattgactgttcctcttcctggcattgtttaatcggaaaatgcttttagaatagaaagctatcactctgtccagtagtatctttttatcattgagatgaaagactgaggttacattctgcctctgctacattcaagtcacttgcctcaagatcacacagcagaatggtagcagaggcagaatgtaacctcagtcttctgtctcctgttctggttctaggtctatcaagtgcatggattctccagcttcccaagtcttgcatctccatcttcctccttcccctcatcttctggcaatattcagttacccaccaagtccaggaacttcttccttcaaaatatgtcgtgttcatatatatgtttcccaactcaaggacctatggctgccatgttagttcaggccaacctcatctcccacttgaatccccgcagaagttcattgttaaacctctctcctgctttcttacataatacctgcctaaaggtatatatgaaagctaaagtttcaaaagtcaccaaatagcttttaaagtctaagggctgtttggtcccagagagaaaaatgattttaaaaaattaaaatagtaccatatcatttagacataatgttttgattacatatgttctatgattttataattttttgttcaataatttcagacttacagaaaaaatgtaaaaatgatacaaaaattgcctgtatgcctttactcaaactccccaaatgttagcatttctaatgtttaccattttctctctctttatacatttttattattattttttcaaaccatttttgtgagtaagatgtgaacatgatgtcccttggtcctaaatatactagtgtggattttctgaaaacaaggactttcttttacataatcacagaaacattatcaaaatctggatattagcactaataaatacaattgaacaatctacagactttatttaaatttaatcagtggtcactttaaaatcctttctagcaaaaaaagtttctgatttctgatccaaaaaaggataacttgttgcaatttgttgtcatgttctgtagtctcctttagtcaggaatagtaattcagtctttctttgtctttaattgaccttgacatttctgaagagaggccatttattttgtaggctgttcttctatttatgtgtatcccatggtgcctcgtgattatttgtgtctttaacttttatgtctctttaatttttaaatgagttaatatttgtaaattgctttaagcagtgcctggcacatagctctatataaatatttgttaaatacgctttgatccttttcttcacagccaaatatacagttgaccaatctatggccaatgagtacttgaaatggaagatttgtcatttgggggaatttctaagtattttcatctttgtttcaactgctttacctgtctgaaaactatgtttcttatagctaatatcagcatttacatttgtacccctttctgtacttaataacataataaaaacaaaaccaaatctaccattaggtcatcccacagaccctggcctgtggatagagatatcattgctgcccaagttgagttcttggctgctaggcagggtcacctggtccttgggtgctcaagaatcaaaacctgggctatgcgtgtgcagcataatggactaaaaatgtgagctatccaaatattttaagaataaaagtggaagacttttctgcaaattatggcggcattggtatggtattctatgaggtatttaatttaatgttcattgcagaatgggatttcactcaatattttttgtttgttgaattacttattgcttccttcctggcacaaaccttgtgggtcagcagactggactccttgtgtcctactgggaatgtgatgcatcacatccctgcttctgggcttttgcttctatggctccatctggatggcccttctcacatttccacctgctctcctgctcaggcctcttaagctcgacatagccccacctctcccgggccctccctccacatctgtctcttccttctcagtcccctgcagcatctctgctctgtatcacccagtctggcactaaacaagagatagatttgattctgaattagctgttccctacctcaagccccattcccccaaatgggctaggaagtctttgaagtaggtataattggaggtagatttaggtttttaaaaagttgaatttccttgacaatttaaatttgagaaaattatatttgaagatggagcatgaataaggtcgtatatttcttatcacctcaaacatggatcctatatgagctagcatttatctaaagattatttccaatgacttgccaattattgtgctattttacatgtattatttcctttaatctttataggaactctatgatgaggtggctacaggctactgttaatattaccattttatttagtagaaagctggggctcagagaggttaagcaacttgcccagggctatatagtgatcaaatactagaatcagaattttatttcaatccacctaacttcacagcttatgcctgagccactatattattctccctccatcatcagcaaagggaaaaaatagcattactgatgaaaacagaggaaaatggtggctttatttagaatgaactaacatttgttgattatctactgggtgctgggcactgttagacactttcacacatattacctcagacaaacttgagcaacgaccctggaaaggaagcaggtactcttatctctatttcataaatgagaaaattgagaaacagagaggtcaaatgacttactcaaggatacagagctcagaggtgatatgtatttctggtacatttagcttcatccggtaacacacagccccaacccttttcacttgtcttacagtagtgcctctcttctcaaatagaatttaactccacagcataattattcttgctctgaatccccactgtctcatggcgtcttttagcatcagtgtcttctagaagagcctccaaggaaaggctgctgggcaaggcactgagtgaagcaaggggggtgtatattcctgccctgccttctcctccggctgatgaagcccacagttaagatggtctaccggggctcgctccagtcttcccagagagtaatgttctgctcaggggtgatagaaagctctgtggctggcccagccgaggtattggagaaagatccatcacccctgagtgatcggtgacccacaggtactgcgcatggaacctaatgaccagtcactcaattaccggctcagtgacatgtttgtaagggtgaactttagagtgctactagggagcggacagatgaactatagctgtgcctgcagggcagagctcacccagcccaactgcctctgcggacccattacccagtaattagggggatttttaagtaggaagcaaggagttaaattatcacttagattactgcttcacttgtcacagtagaaagtgctgctttggggaaagaaggaaggattggggaaagcaagagagggagagacggagaaagagagtaatggaaggagtgtgagagagaaggctctgggaaatcgaggtttgagataagggctccattcattttctccactggcaactgtaacaggaaggtgccaagggtgaccaatgagagatgcaggtaagttgagagtctgagccacagctgaggtttgcgtaagtctctacccacagcatctgtttaggccatggtagctcatcaggaagatgaaggtaataatacaatcatagttagcaatgattgattgtatatgagccaggaacttggctaagcattgtccttgcatctgctcatctgatcccttccaccctgaaccagggggctgccactgtgatctccgctcaccagatgagaacactggagcaccttgactatgtaacctgcaacagagctggagtgacctgctcaatgccggggcccagcctcttaaacccctcaccaagcacctctgtgaggtctttacagtcctgaaacagccccaaacctgcctcttctgcagaggcaggggatgttctcagtttgctccagacttccctgtgttgagcttagctctacgtcttatttcctttgcagcaaaattggcaactgctattaatttttactgtgtgtgtgtttaattttttttaatgaaaaatattaaacaaagatcaggtagacagaattgtataacagacatttatgcactcatgacctggcttaaaaaattgttaactactgatcaaacttatttttctgtatcccccatccaattccttctaccttcctgtattatttcgaagcaaacctcaggtatcaaataatttcacctctgaatctttcagcatcaaatataaagatttttttaagaaatcaaaatacttttatcatgccctgaaataataattattatccaatctgttcaaatttttaaattttattggataattttagaaatatagacagttataatggttcaacttaccattttttgactacattggtactcaaccattctatttttcgtggtcagtacagtattcaatacattacatgaggtagtcaataccttattataaaataggctttgtgttaaatgattttgcccaactttaggctaatgtcagtgttcctagcatgtttaaggtaagctaggctaagctctgatgtttagtaggttaagagtactaaatgcatttttgacttaatgatattttcagtttatgatggatttattgggatgtaatcccatcacaagtggaggaacatctataatttatttgtttaaattaggatccaaataaggtcggtacattgcagttggtcggtacattgcagttggttgataggtgttttaagtctcttttattcttttttccttgatatttatttattgaacaaactgtgttatcttaaagaatttcctacagtctgcattttgatgattggatcttagtggtatggtatggtttatcatgttcctgtgtccctggtgttttctataaattaatggttacatctagagttttgatcaggttcaggtttggttttttggcaagaatacttcatgtatggtactgtggacttctactaggaagtctggttttctttctttctgaagttagcaaccactgaagattgctttaatctggtagtttttaattacttcattcttttttcatttattatctgaattacattttaaagaaatcttattagctatttgtgatcctgagaaatagtttatataggagaagcaagttaatgcttactttcttccctttattttctagtttttcaaataatgagttggttctctagtattctacataggatgcgaatgagcttattttattttattattactattattttgtacccatagactttttaagttcttggtaaatttcaatccattacagttattgttctttttgagatccaaattctcctgtgtctggccattgggagactttaagttgactcctgagtttttcaaacatgatcacatggtttttagtagcttcctgctgtctggtttgacagtaggttccagactcatctcctacactttctttttcaaacctagtctcaggcttttgtcagttaagaatgacatttagatagcacaattttcattttggagtactcatggctactaggtttgtcattgtctctagggcttttttgtggataccggtacaaaatatgtatcttgtttaaaagagaaaacaaaccttgagtttatattgatactctcaattcgtttttacttactttctttgatcattcatctgtatttcttgtttctcctgttgagtatcccagttcccaaaggtaaccacatttgttctatgccaccatgcacactcaattgtctcagaggagcaataccagcactaccactaaggtatgattagtaaaaacaacttaagggtttttatttttccttaattcatttaggctggggatgtcctgccagattcctgtatcttaaaatcacttgacatagttttatctgtatggttgtaccctcaacttcatgtatagatttattcatgtattccattttactttaattttataacaattgccttttaagctgtatttattaaattactatttcacatgtcaataatacacattcattgaaaaacataattatatatatatttttataatgaagtaaaatgcatatgtgattccacagtcaaacctacagagcagctccttctacactgattcacagagctcctcagcagtattaagctccgagtaccacatggaaattgacttgaaaacacacacttaatggctgctttttcttctcccatcttactttctcacagccttatcaattttcagggatcacatcaaataaactacttttatacaactctttgtctttagtcagcatctaaagtaactcaaatcaagacacacatttttctctatcttgcttttcatataagaaaatatcctgaattttcacttgatttcatttcacagtgaaatgatcacttcatcgttctggagataaccatggctgctttcacggaggctcctccaaaccctagtgccttgctggaagggcctggaggagctggattgagcaggcacgttggagggagatcccacctgagttcagactgtggacactgctgaagttctgggtcagagcacacatctattccttgagaagtagggcagtggctaagagatttgattttgatgccagagtaactggagctgaagtcctggcttggcaggtatagttgtgtgacctgagcaagtcacttcccatctctgagccttggtttcttcttttgttcaataagcataataatggcgcctgtcctataaggtacattggtgaggcacaataaataaagtgtttagcacatgaaacactttctagagatatctgtaatcaccatcacctctaaaataatgagactgctctagttcctttctgagtgcagactgtctttttttaagttttattttattaagtgataaataataattgcatgtatttatgaggaacaaagtgatatttctgtacatgtatacattgtggaatgatcaaattagagaaagagtagttagcatatccatcacttcatatctttatcatttctttgtcttgagaacatttaaaatcctctcttttagctattttgaaatatgcaatacattattattaagtattttccaggcttggagtccttggttcttttaggaagtcctcataggatatgattccaagaccctctccgccctgggttgcagcaagtccagacgtggctgtaaatcagatatggatacattcttgatttctattcaagaaatagacaccatcctcccagtgtgacatatctgccagagaactcaaagaactcctaatgaaattttctcattaggaatttctgtgaacttctctcatcttgaatttccctgggtgttctctgccccatggcctggcctttccccatacggatcagggaccttccatctgcttaggccctctttagccctctcctaggaccccatccttctttccaacaacacaggtatatcctgggggtcccaacaagatatttttatgattagagaagtctaggtatttcctgataattgatcatttgtggtgtaaaagtgttttaactctttactctgaaaagaacgtctgtcctgaggataggtaataaaaggaaagtatggcatgaccctcttctcgccaaggaagcaaacctggaagatggttggaggaaagcaaaggagaatatttacaaataaggaaaagtagaatggagtttccttgtctacttagtcagtctgtcttgcagatattttgaaagaggcaccccttagtaggctctatagccatctgtgggtcagaggtctcagaggaaggaaggggtggctcaaatacaaaatggtacccctaagggccgcgcaggtcccccaatcccaaacaatactcccatgtgccagaggtgaaagtgatgatccactgagctgaagattacctagagttttgctaaaattctgagcaggaggttgataaattatcccagggaactaagggttgtgtgatatgaaacagatgcatagatattcctggcagttttagaagaagggtctagtcctcagagagatggcagtgactaggtgggactatgggatacatgtattttattagatttaaagtatttttggatagtgggatacaacacagagccactcagatagatggagaaacagaactctttgttacttacagctccaagtgagtgacaaaaagaaggctgccatgcagggccatatggggttgcagtggggatatggtaacagcaagctggagcaataggaggtggcaagtggcatggaggtagctaggtttcaatagctaatgtgaacaattatgtgggctcctgggtttagggtttatttgtttggtacttggccctggaaaatggggacctgataagggaagttcttggggtgcttgcatagtggcccaagggagtggaagccagataaagaaggtgattggcttagcaaactgcccatgaagggaaattgagaatttttagccataatttcaaaactgggtcaaggcagcacttgtgaaatgtcaccctacagcatgtcaatggggttcagggcagatcctcagccttggagaaatttaagttaaagttgggctagaacccaggcataaggcttggaccaaatttcaggaatcaaaacagggaaaccaaatgagtgacatgcatgccattaccatcctttgccttgatcatggcagacattgccaaccaaacacaattctcctccttactgagcctggactcagccttgaatccttctcagctaccatccctgacaagcaacaaagttgacatgtaattttcaacccatgactacacttcattagaagagagaattagttaaggggcatgtggctatctgggtttcctgtaatttgaaatctatggatagcaaatataattccagatcccacccactggttggactaagtgtttctcttcttagcagcattgttcagggactgagagaggctgagtcataaagggctgggccccgggacagaaagtgacatggagctggagaaggcagagtctaacagtctttcaagcacagcacccaatcaaaaggaatgtacctctagtgcggaaacattggagtagccctaagtaacccattgagaagccagtgttctcaaccatatatagacggaccaagacccagccacaagatatattccagttgtggaatttgggtcagcatgtgaaggtgggatgtgatatttgatcttttttgaaaatatagctacccaacttcaacttctccccaaagctatgctatatctgtatccttttctgaagtattttattaatcatttcatccatatttctcttcacctcagacttcaaattttgatttcctctggtatttatagcaacatctgtggtttctcaaggcgcacaaggcaggttttaggatgaaggtattttcatggaggctggcaagatatctgaggttcaacaacaggcagctgactcaggtaaaatgaagccaaagagaaaccaaaccttgttttcttgattttgtttttcctttcagggagggagagatcactggccaattttaatttaggtttcttctcccttagttatccaaagatgcaatcaataaatacctacttgaaccccctactaggagccagattgtgtactaggtactggggatacagtaagggaaccaaaccagatatggtccccagcctcctggagctctcctgggagaaagagagcttaatctaattaatctcataacaacatgtaaaatcacgtctgatgttttgagagagaggtatatggtattaagaaagcttatgataggggatttaacatagtgagggatggcatccagaagcgaatgataactgaaatgaaagaaggatctgaaggagttggagaaataaaaagagttatgttgtagtaggaagggaattctaggcaggtggcacagcctgtgcaaaagctcagcaactggaaaagaacatgaacgttatgtgacaggaagatagagtggttggaaaagactgaatgagagggacatgatggacaatgagtaggaaggagtgctcagggagtgacagacctgacactgtaaacaattcagacgtggatttactgagaagctaatagcatttaaatttcaagaactctcatttgcattggggctttcaagaacacttgaacaagggcatgaatgttgtcaactcagttttcttttctttcctgttttttttttttttgagacggagtttcactcttgttgccttgttgcccaggctggagtgcagtggcgtgatctcggctcaccacaacctctgcctcccgggttcaaacgattctctgcctcagcctcccaagtagctaggattacaggcatgtgccatcacaccggccaattttgtatttttagtagagacagggtttcttcatgttgatcaggctggtctcgacctcccaacctcaggtgatccacctgccttggcctcccaaaatgctgggattacaggcatgagccactgtacccgaccacaaacagttttaagcttactgattacacaagaaaacttttgaaatgtcctgaaatctcacagctcatctataaaataaactggataggaaatttttaaaatttgtccacaatcctaaaaatttaggtggcgttgccaatattaaagctgcgaagctgaaggataccagttttactccaccacaccagagggaaaatatttcagaaagtctgagttccttttcttttctttctatagaaaatgacattacaagctcattatcatatgaagaggagatcaaagactatgccggcaacaaaatgtaggaaaaattgttatagagttgtatcagtctgctaattaacaaaaatatgctatttttcaggagtttgtaatgttagtggtatctgccactttaacaaattgtagtttatgagttattttcatattctaaatacatattcaagtttgtgtctaattttgaatgcagaattttgtgttcttaactgactgcccactgttagtcattgaccactactatcaatcttccgtcctatttccagggttataattttgaagtataaatcattaccaggtctctccaactcttaaaacccttcccttgtatgagtgggtggtaccaggcccctagagatgatctttctagactcagctctcagcactgggtggattcattcatgttcaggcagagcggtatgattaacagagaggctgggacacagggtgcccttgctcctccctcatccttatcggaggatcttcccaatgtatctggcttcaggccaatattgagggttccacatagaggcagggagagaacactggactgtagatctcagtttgaagtcagcctctctcacatactacgtagtcaagtttctgagtgtgtaaaccagaccaaagactctggaaagatctgcacgtaaacagtgcttgacagaaaggcagcagcagactactaaagatataagattgccttagtagcctcagtagcaagcaaaatggaagatatctgtactgaggcaagaaacgcaaagcaggagatgatctgtaaggctgtcatagggacacacagcttatttttttggtagtggaacattttaaaaacttaatgcataaacatatgaccttttattaaagagaaattttatgtattggtggataaggccaatggttacatgtactggatgctttaaaaattagaaccaattagagtagattctttattctcttggttacattgtgaagtgtcttttatggtcatatgctgtggttggaatgacagtgtgcacatatttcaagaaaattagaagatacacgtgaacaccaaatgttctccccttttttctgcagtagtcttaatgattttctccattatctcataggaggtggagggagattggtggagggattttcagtggtcactgttttcttcacatggtcttgaatgatgtctttatacatgtgttcagctgtgaaaatctgctgttcctcatcatagccaaaaaaccatagttgtgccatctggtaatatttaccatatgtgatgtaaaggtcacaagttttggtttgcaaaagagcatcttcacctccaacatcactttaagctttacaagcttcttctattttcctttcatctagggtagctttatctgcttccagcaacccactctcttcatattattccataaatgtagattttccttcatctttttcttcttcctctcataagactgagcagttttcgagttttataccatttttgcttgtaagtataatctcctcaacctatttgtttattcctgcaattcctgtgctgtgatgtgtatctacccaggccctaccaccatcatcttcagtgatagcttccaattcacctgaatatgccatctgttttgactggatgtagcatgccacatttttggctaccaaaaattatttgcctgttggtagctatgcctctcttttcagttcttcccctgtagcccattgctgtgtcgggcagtggacagctaagtgatctccagctgccataaactcttttggggtggtaacagctgtttccttaaactgattccttgagaattaggtcaggtattcagttacttctaatgcctttccttcaccatattaatcaattctggatggatgctggggctggagtagtggccagccccacaatgggatgggaaaggtacctaagacagaggccagggagtcagtgcccccgtgacatgaatttgcatcacatgacacatcaatatgatgtgaggactctgcagatttttgaggcatcttctgccattctcaggggcaaagagatcatgaaatatacaaaaatgccatcaaacccttaaaccaaagcatcacagttatctgttgtagatgtatggagaagtgaaataccctaaatactgcccaaatcattgaatacaagttttgattcccaggattataggttcttaaaattgagaaattaaaagtcacttaggatgacaaaataatttgttgttcgaatagtgaagaacaattttgagagtaaaagcaggagttctttacggttatgtcaggacagcagacataaactggaaattctctgggcacaccaggatgagtgcttgccttgttcagacctcctatttggaggaagttagtttttgatttgcaagcatatccagtgttcgttcagtgttccttgcacagccactggtcctcagctatgtgggaggatcaagtcaatgccatcccattcctaccttggtgctatacagaatcaaccagacagaaggaatttacctggaggccatcaatttgggggtcctcttggtatctttttacttttctagaatttgcagcaacatgcctgcttgctaaccagtacacagaacctcagtgcattctagaacgtttattgcaaggccaaatatgttagcagtcacttccagaagatcccttggtaatttacccagacatcccagaagtcctctttcccccaagcccctcagctacctttttctctggatagttctaacactgacctggatctgaaacctatagttccaactccacttttccagagacacttcactcctagagttcattggattagaataagcttttttttcaatttaccagagatggtaaattgggcaaagacattcatttaagccaatggttctcaactgggggtgattccattctcccttgcccaaggacttttgcaatgtctaaagacatttttgatcactatgacttgagtgggtgaatgaagcaactgacatctgatgggtagaggccaccagttctgtggaaccacattgcacagaatagcccttcacctttccccaataattatcccatccaaatgtcagattccaggttgagagactctgatttaagtcaatgaataaacactcgaaaagggaataaaatgactatgtagtggtactcacattcctcaatattacccccaaatgagcaacttcctttatgtacactacctcctttataaataaactgataaattgtcataaagtcttgtaacttaagtagtagagagcttttctctgttagttttaactgagaagttgacttctttatcttacaactttgcaaattgttacagtgattttgagcaaaattcaatgctactcctacttctgattcttctagtgctgctgctaaacagtaacgatgtattgaatgtttactacataccaggcactatgctaagcacttatcatatgttatctcacctcccaacaatcttgtgagctaggtactattaccattgaactttactcctgaagaaactgagggttataaaggtcaagggacttccccaacgtcatcaatttgctaactgagaaagaaaggtgtatgagtccaggtatatctgtctccagagcatgcagacttagatgctatccttgactccctttctcaaagcaattccattgatagattctgtgtgtttgatgtcattagtaagcagtgaagaattgctgagggaagcttcttgaaaaaaaaaaaaaggatcagattcggaagttggcttactgtgacaacaggactactcccagtctagcttgtccatgaagctgctgccatttatgctgcagaatgaagagctcttatagtagattataaaaatggccacaatattatgtagcttcttccataaagaggtatttctccactccattaatcaggactgctttttgccttccttttggccaatagaatgcaacagaaatgactttttatgaattatgagcctgggcctctgctttcgtctcttagaacctgccactaccaaataaacaagcctaggctagtctggtggatgggtagagacatatggtcaccccactgaccaccagccaacccacagaagcagaggcatttagtcatgatcagcagccaatcatgatgtatggggaatcccaaccaagatcagcagaagaacttccaacctgagcccaaagcaaattgttgacccatagaattgctgttttaagttttggaggagtttgttatatggtaaaaggtaactaacactcatgtaaggtgtctacgtagtcttcaggctctcaggcctagaagaaaaaagtgtcttagacttttgggataaaatatccaagaagcccttgcatatatgtcctaggggtttggggaagacagaaggcctattcaggatagggtgaatttaaaacctagttgccaaattctttgacactgctccaattgaaatgggaggttgtgcactttaaccttggatctgagtactgtgattgcttgatcaacagaatatggtgaaagttacactgtgttagtttctgggcccaggccttaagaaactggtagtttccacctactgtctcttggaacactcattcttggaactcagccaccacgttataaggaaggctaagtagcccgttgagtggcccatgggatgagaaacatgtggagaagaatagaaacccttagctggccctcagccttgactgagctctcagatgacagtcttgtgagtgagccacttcgaagtggatattctaggccccagtcaagctgcccagctgatgctgcaaggagcagagatgggccttccctgtgcagtcctgagcaaatgtacatttgtgaactaaatacagatgctctttgacttatgatggagctacatcccaataaaaccactgtaggttggaaacatcataagttgaagatgcatttaatacacctagtctacatcatagcttagcctcttctactttaaatgtgctcggaacacatattatcctaatgttgggcaaaagtcatctaacacaaagtccataaatcaagtgttgaatatctcatgtaatttattgaataccatgctgaaagtaaaaaacagagtggttgaatgggtacttgaaggacggtttttactgggtgtgtattactttcacaccattatgaagttgaaaaattgtaagtggaaccaccatagttgagaagcatctggaaatgatttaatccaccaagttgggaggtggtttgctatgcaccaataaataactggagggatcctggagacatgagattctccaaaaacgtggtgaatgctttgctttgggggatgaacaaagggcctttctcccagcagagtgcttgagggcctgttttatctttctcgtagcacttactgtcaccacacatgtgcttgcttattcaagaggctaagcaatgaaaaagcagggactgtgttctcatcactactatatgcccaggatctagaacagagtccgacacacagtaggtgctgaagaagtagctgtggaatgaatgcaaagatggaagacagagagttgacacaatgctcagttctgattttgtgccaggacttttacttacagaattttatgtaatttcaaccttcagagaaaggcattcttcctatcttacagataaggatactctggcactaagaaaggaaatgatttgtacaatatccgacaactattaggtgggtaaacctgggtcctaacccaggttttttgaatctgtatcttaaactcttcctacaatgctgtggtgctttcctcttttgggcccagatgtccctacgaggacctaataagggtattttttacacacagcctgcacacacacatgcacacacattcatacacacaatggttgcatatactttcaggactcacagactcttggtataagaacccttttcttatgccatgaaaaggaaaggcacctggttcttacagacttttgctttgtgccttttcttcagctaaattgagttattaactaattatggcttgtgaagtcctcggaaaatactaaatatggttattagtgaagctttgattttagagaacagcaagggagtcctgaataagcaaataacagttgtgtagggaggctggcagccgacgacatgctgcggtgtataatcaaactctgcgaggctgtcaaaggtacttcagctcactgcttgctacattggtccttactgggagtttatacattttcagagaacaggattcattactaattgattgattttctaaggctccccatgtttcatcttccagcatctatttaacctttattctgcactccgcccccaaaccaactcttttactcacagcagataactctacctcttcttagaaaaaatagaagctccacctgaatttcatccctgcacccccaaatatttccatctagattattattacatctttcttggagtacatctagattacataccatctagccctgcttgcccccctttcagactatgcccccttcagaactggctttatgcacatgtgacttgtgcagtcacacaggactccactgtcagaaaggccccttgtgaagacgatgctctgttattgtcaccttgaaatttttcataatttttgaacaaggggccccatatttttatcttgcactgagccctacaaattacagagccagtcctgcccacttccagttgaatgtttgatgtgaatccttccagttataactgtgcatgttgctccaaagacctcacttcatcaataatgtcttgttctttcaactgttcccactatactcactgacaactttcagtctacaattcctcatccaaaagaaatgagcaaaattcctctgatcaaggtaatgactgtcagttctatattgggatatttttagggggtttcaagggacagaaacctaagtgaaactagtttaagtgaaacaaggatgtttattatattacatgaacaaattgtggaagagtcaggagtggagctggctacagggacaacaggactctaagatgtcacccctcttcatctgtattcgtgtccccatgctagtgtttttctttcagttatttttccatgtgatggaaacttgtctgtaggtagtgccagaccagattcctgcggcttggcatcaaagagaaaagggaccattgtcatctagtttgaataaatacaaaatctgatgaagagttctaattgtctctacttgggtcatgagtttattcttggaccagtcgctgtcacctgtgaaaaggggcactctgattggctgttgagatctgaatctcattgttggagttctgggagagcagttctctatgggaaggtgagcatgatcatgggaagacagagcaatcagtgtctaccctggaccccttctacccagaatctcggctctctctttttcccttcatggtcaatgccattgcaaagccatctatttgaaaaatagtctacattcactcacctgacttcttcacctcccaccacctctaaatatttttattgtctctctgaaactgcctttgtcaagatcatcactggtttccttgtggtcaaatctataggtaaatttttaatgacctcttattcacttccttgcaatatgttgcatctggttattctttcttaggaaatctctcctttcttgttttttattttttcctgggctttgttctccttgtctttcaaaccagctcctccaaggtctgtcttttattgatctcagtttccctgtttctgggcttgtctcctgatcgggttctttaacatgtcccatgaatctgccacggatagcttctcttatccctgatataccgtgcctactagtgctgaccatattttgccaattcagtcatccaggagagaaaaaacggtgaaatgggtttggttcagggtgtatggctattaacaagaaaataatgagaagaattccaacaattattaaaaaggtagaatcacttggacttgatgataggttggaaatggagagaaagagagagggagaggctgaaaataccttttaaatttctggcttgggactaggtggtggatgctgccattcacaaaataagggcagtaagtgtgcatgtgattaaatgtacatgcttttgagttccgggatgcctacttgggtgtacatacacatacgtgtatagtacatgcttatgtgaatgtacttgtctttttgtgagtgaggacttttgagcagttggaggtgtggagagcatgtggtataagtcaaggtatgcatgtgtgcagggtggtcaggaaatgaagacattcgcatatgtccacaggcatagaggtcttgagtcccaccagctgtgtaccccagagcctgtagttctgaggaatagccctgggcaacaaggaccaacacattctcttagcttatcaccagtctgttccttacattgtgcctgctttaagaagtcacacagcatggagtgtgcttaattaaattccactacaactttaaaaagagctaattgtagttgttagaaacatcaggtgcacattggctgatagaaggagacgggatgaaaggttgaaccttttctgtaatccttctcacctgccctggatctgaacttttatcagtctggggaaatgggcttatggtgtattcagtattgattcctgccatcttgttgatttgcaactctggaggagggttgagcctgccactggagctaaagaattccagttttggagcaacatcagggcagatgagggctttctggatccagaaatgggaagaaggtggggacagagtcaaagaaggtaggggcatatggaggcagttttacacttattactctctcctttttggtatcaaatttattttagggaaacacaaaccatcctcttttgtctactctccacttctgtcagttcttatcttcagtttcctcacatgtaatgtaatgttaataatgatatctattacattgggatattttgaagattggaagtaacagacgcaaatcacctatggcccagggcataccacctgttgctccccaccagtgggttgtggtagtgattgtggcagcagtaattgtagtagctgtgtggtgactactaaaagtagccacagatgattgttgaacacttaaaatgtggctagttcaaatgacacgtgctgtaagtgtaaaatacacgctggattttgaagacttggcataagaaaggtaaaatatcatcaataatttttatgttgattacatcttgtcatgatactatttgggagatattgaggtaaatggaaatatagtattaaaattaatttcatctgtttctttttacattattaaaatgtactcgtaaatttaaatttatatatgtgggttttattgtgtttctgttggacagtgctgttctagagaattcaggcaagaggtagtaatcatcagttccagaagtactgaattcttctggagtacagggatgaggctgataactccagggatggaggctactgagatcaagtttgacctctaattgctggaggtatcatgcagaaaaaaatgctcagacacagggcctcaagacagaggccctgtcccctacccacttgacactaccccagcttgcttatggacaccatcatctcttgcctggatggctctcacagctttcttctaactggtctttcttctaacagctttcttctaactgatctttctgcatgtctccaagaatctagttttctgtcactcctaacagccagagtgatttttaaaaatacctgattctactcaaagagattcatttaaatccctttcaggcagtctttttggaattaaatctaaggtccttgcaagcctggcctggaaggtcctccatgatctgctctcctgcctcaatttcctccattctctgcttcactcatattgcatgttgctgcctcatgagccttcattcactaaaacatgccagctgctttcctgtctcagggactttgcacatgccatttcttctgcctgcaacattcttgcctaacacctcacatagctggtaccttctcatgcttcaggtctcagttcaacacatcatctcctctaagaaatcttcttcatccacattctctaagtgccctagtttccctcctactaccatgttctttttgctcattccattatcaccatttgatattaatgtgattactcattcaatctttcagtcatcactatgctgtaagctccatgcaatgggtccatgtctgtgttgtatccaatagcacagaggctgtcatataggaggcacttgggaaatacttgctagaaaaagaataaataaatggaagtctgttgtctgaaccaggacacaagttcaatgacagccttaacaatgatgacctgatggagaaggactgaggctctgagatggggtgggaaggatcagccactccaggggagggaagaagaaagacacagaggctggagaagcaggcagggcccagcctgagcccagcaggggcagcttggctctgcctcatcacaagaagtagcttcagagctcttcaaaggaagcgagtcaagatgggtcagtccctggaggtgtcactggccctcagaaggcctctgccagggtttgatgaagcaccttctgtggcaggtctcataattaactgtgaccatgcagtgtgttcatgcagatgtaaatcatctggcagatactttggggcttatctgctaatgaaaactccttcgcatttctgtaagcatattatggtcaattacaattaattcagtttgcatcgactgccattttccttatgcaaagattgtgcaaatcgagtgtgtgagccgagggctctgaggcctgtaaaatccataatggttagctttcagggatggtgaggaaagaataaaactgtgggctgtttgaaatttaaatcagagcagggctggtcaatagaagcagaatggctgcacttggatttgttgggctggctgtgctgggggactaggggcatcttcctactacccaaggttacagggtcacagagtgtaccctgtccctatcagtttcttctctgggctccacttctgcatttctggctgcagcctctctaagacccaagggaccagacttcctgtctgaggactcatagccatgtgactcagattactgctacttgaagagagatgaggttttctctttttctttcccatagctccaaggagtaagttgggaagatagcaggtgttaaattgttaaaatttcgacttctggaccagctgacatttgttcactattaactgtgtgccaagaattgtgctcagtgcttatgcatgttttctaggtatgtgtgtgcatagcacacgatcctatgaggcaggtatttgcacttcataaactttatagatgaggcttagagaggtacagtggcctgttcatgacatacacctaagaaaagtttggtttgaatctagattttaaatcactgtattatacaatcactgggaggactgaatcgtataaaaagtgacattcagtctctattgcttttgttgtcagattcagctgcagtcaatacctgaagaagagaatggttctatgtcatttctccttttctgtaaggagagcagagaccacagggcttcccatgaaagtcagggagcttggcttgctgggcattcctaggcaggcaaatgacagagtaggacttcggttgtcaattgctgtacaagctaggatgacctctggccatgaggtgtgttggaaatctctttcagagtagcctcttcttctgaaagaccacactcagcccaagcatctagagagaacctcagaggctgcttgaatagtactgagtacagtggaatataggtgcggatctgtataggttgtggatttattgttcaaattttcttgtttttaccgaacttccaattgccatcaccttcatttctttacttaaggtttctctggccatgagggtccacgtggcccaagcatgtgacaagccagaagtaccagagaattaacattcctcaggagcatccctcaaccagtgagcagtagaatttgatgtgtaaatacctcaactccctcacccctcaggtaggataactctgcagtgcatgtgcaatgctggcttctggaattccccggcaggatcatgctccagttgcccatagcaataacctggttgataatacacactttattgcctgctttttcttccttctctcccttattggtatttcccgagatcaccttctaaataaaacaattgcacttgaatctttgtctcagagtctgcttctggggaaaccaaactaggttagctcctaaacttaagcataaactgacttgcagcactggccatgaacacaatagcaaagacagggaaacaacctaggtgcccatcagtggtagattggataaagaaaatgtggtacatatacaccatggaatactatgcagccataaaaaagaatgaaatcatatcctttgcagcaacatggatgcagctggaggccattattttgagtgaactaatgcaggaacagaaaaccaataccgcacgttcttacttataagtgagagctgaacattgcattgggtactcatggacataaaggtggaggaaacaagaaacactggagactactaaagggtgcagagaaaaaggaggaaagggccgaaaaactacctagtggatactatgctcactacctgcatgacgggatcattcataccccaaacctcagcatcacacaacatacccatgtaacaaacctgcacatgtacccttgaatctaaaataaaagtggaaattataaaaaacttaaaaattaaaaccttcaggcaaaaactctagggataatgacacagaaaaggttgctgcctgggcattagaagaacaccacacccaaatagctcaagcctgtggccaaagataagaacttggaggcatctctccttcctagtagggctcctcactttcccaccacttctttttaggcatttagctgagaacttaaaaggacccacaccatattcccttatatatattgttagttgccacgtgtgctctctgtctgcctggctcttccttcttgcgttgtgtgacctggggatggaggaggaatgctgtgtgctcctctctggccaccttgcatagctttaggatccaaaagtaatttaggaacaatgcttgaatttcacattgtggttgtgtcattgaagctgtgctcacaatctaacccctgatggtgaggtaaggatctcacataggtggatttgttgctggggctcttctgtttggacctccgtcagctgctggagatggtagctaccagctaagtaacagagaaactcaaagacttttgtctaaaagcctactgcaaaaagaaagtttgatgatttaaaaaattatttatttattttttgagacagagtttcactcttgtcgcccaggatggggtgcaatggcgcgaccttggctcattgcaacctccgcctcccaggttcaagcaattctcctgcctcagcctcccaagtagatgggattacaggtgcctgccaccatgcctggctaatttttgtatttttagtagcgacggggtttcaccatgttggccaggctggtctcaaactcttgacctcaggtgatctgcccacctcgacctcccaaagtgctgggattacaggcatgagccacccatgcctggcctaaaaattgtttaattttaatcatacaagtaaacataaatatattcttatggccaaaaaaaaaatcatactttatggatactgtcaaagtccccattgaccattcttcctagtacctttcctgaacagaaatgaccattgtcattattttggcatttctctttccagatactttctatacattcatgtgtgtgtgtacatgtgcagcaccccaacactcaatccactctacattttgacccacaatgtacttttttttttttttttttgagagtcttgctctctcacctaggctggagtgcagtggcacgatattggctcactgcaacctccacttcccaggttcaagcgattctcctgcctcagcctcctgagtagctgggataacaggtgtgcaccatcatgcctggctaatttttgtatttttagtagagacggggtttcaccatgttggtcaggatggtctcgaactgctgacctcatgatccacccacctcggcctcccaaagtactggcttcacaagatatttgagagttctttccatgtgagtacataaaattttacctcacttctgttaaatgctgcataatattgcattgtgtgaatttagtttagtttaactactcccctactgaaggatatttaggttgtttccaatctatgatggcttcagttgtgggggcttcctcctttgagcatgggctgtctccctgagggtcagttcccccaaattaagggctctctttgcagtaactttcttgtaaatcctgaaacagccacaagctagttataaaatgaagatgttatgaaaaccagttagaattgctggggaattccagacaacatcacgtgactcctccaagtccctagagaactagaatgagactctgaagaggtgggttgggacaggatgctggagagagaagaggggcaggggagagagcagggggcataagggctgaggaagaggagtcttttttgctcctaaacacttgaggttccatttgctaatttattgtcagaccacagaaaaattgatccctcctgctccagccagatgttgctttcttgagttctggccttgcccccatagctctcaccacatcaaggagaggactagcaataagaaatatatttttcttcagtaggattgaaatcccccctattgtgttcttcttcaccatctcagtcagggagcctgctctgggaatcataaattatcaggttaaaccatgtgaaggtaacacttttcaaagtcaaaaatggtcaaataccatcagtttcatatggttcaactgaataaattttcggagcaattccaatttatcttttaagtgatggggttaagatgacagtttggggactttgcctgtgacccttcaaaattccggggtaggacttaggatgctaattgttgcataaggtagggttgcaatttgagattaggttggttagaggtaaggttgggaatagatttgacaaacatgtgatgtaatttctgccccttgccaatcctttttccattgcagccgtcactaattgattaaagtagtaatgcttactaaacccagatgtgaatataagataactttcaatacatcactctaaataggcacagcctgttgaccagaaccagtactaatgatggagcccacagccatctgtcgtgggagggagagcttggtttgatgaagggatagatttaaggtgatgtttaggtttgcttcgggattatggccagtttaagtttgttttgattttaggataagcttagtcaaggaaaactcttgactctggcttagaagcaagattaattttgagtttcgagtatgaatggtttagtactatgtttagtttgttaatttatagttaaggttaggctggattcagagtgatgctcagatttgtgtttcgtctaacttggaggtcagggttgtgttcagaattagattgagtgaattaggagaactcaatattcagcccttaaaacttccacttttttaactgtcctgtggtgttaaaagtagcagcagtagtccaaaaagtattatacttggatgatatctctaatatgcatgcagacagataagcaactttggtaaattacttagcaattctgggaacatttttagcatttggaaagagcaatattaatggtactgcactgtgttttattttaaatgaaacttatgtaaagtgtttagccagtgtttgttagacaataggcagtcagtaaataataagtctctttatcttttttttttttgtgctggcatcttattgcttcataaaactgatgacaatggtagttacaatttattaagcatttactgtgagagacacaatgattttaagcctttgacacatattacagtcacacactgcataacaacattttggtcaatagcagatggcatatatgatggcagtcccataagattataatagagctgaaaagttcctgtcacttagtgatgttatagccattgtaaggtcatagtgcaatgcattgttcatgtgtttttggtgatataagaataaacacacctactatgctaccattcatataaaagtacaacatatacaattatgtacagtacataatacttgatagtgataataaatgatcatgttactggtttatgtatttattatactatacattttattattttagagtgtactcctattttaaaaaaatgttgattggtggctcacgcctgtaatccgagccctttaggaggccaggttgggcagatcacttgaggtcaggagttcaagaccagcctggccaacatagtgaaaccccgtctctactaaaaatacaaaaattagctgggcatggtggcatgcacctataatcccagctactcaggagtctgaggcaggagaatttttgaacccaagaggtgggggttgcagtgagccgagattacaccactgcattccagcctgggcgatggagtgagactatgtctaaaaaaaaaaaaaaaaaatgttgattgtaaaacagcctcaggcagatctttcaggtggtattccagaagaaggcattgttatcatagcagatgacagcttcaggtgtgtttttgcccctgaataccttctagtagggcaagatgtggaggtggaagacagtgttattaaatgatcctcaccctgtgtaggcctaggctaatgtatgtttcttagtttttaacaaaaaagtttaaaaagtaaaacaaaattaaaattttatagagtaagaatataaagaaagaaaatacttttgtacagctgtaaaaaagtatttgctttaattctaagggtatatacaaaaaaataaaaagcaaaaggatacaataacaaaccagaagataataaccggggtaattatccttagataaaacaaagcctactttaagaaaagcaggattatcagagataaaaatagacattttataatgatgagagggtcaatccactaggaatatgcaataattctaaattcatgtgtacctaattaacatagtttcaaaacttatcaagtagatatatggacaaccatagtggagctataattttctcagagctgacagaacaaacagataaaacgtcagtaaagatagagaagatctggttccaattgacgtaattttcataaatagatctgatttactgaattgaacaaaactagctgacttaattgaatactaatttagtgttgataaaatattttttaacaccacacatggactattaagtaaaattgattatattttggaaaagaactcaggtttcaccaaatttaaagcattaaaactgttcagcatatattctctgacagccatggaactgagaaacaaataacaaaaataaaattagaaatgcttaaatatttggatattaaacatttcatttctaaataacctgtgagtcaaaaataaattacagtaaaaattagatagcattttggacgataaaatcatgaaatatgaaaacattcggatgcagctaatgttgtgttagagggaaatgtatagtcccatatttttatatgcataaagaagagaagctagaaattgaccacctaagtattaatctcaagaagttagaaaatattaaacacaaagaatatgcaaagaatatgcaaacacaaagaaataaaataacaaaaatcaattaataatacaaaattaataaatgataaaacaaatatatgataaagacaaaaaaaccaaaatgttgattattagagaggctaaataaacatatagcaagactaatcagacaaaaattagagatggcaaaaattacaaaatgagaaaagagattaatatagattatataaatatcaaggatataatgtaaaattttacactgattcattaaaaaatgaagattaatgataaaaattccataaaaaacatgatttgtcaaatttgacctataacaagaaagagactatctgaatagtcatatgttaccaaatatattaaactgaaatttataatcctccctcacaaaaatctttaggtgcaaattactttgccagtgaaattttaaagaaatttatgtaagaaataatacaaatattatgcaaacttttaaaaaaattacaaataaaaaaatcaggatactattctttggtcagtgagtcccaaacaaggacattacacaaaaggaaacttataaaaacagtcacattatttattatattgatgacattaaagaaaaaatgtcaacatctcaatacatacagtaaaaacattggaaaaattcaagacctgatcattgtaaaattgtgaagatatctaaaaataaaaggaaatttactaaatctgataatatctatgaaaagtcacagagcaagcatcacataatatttaatagtgatatattaaaaattttctctgaagttggtaatgacctaaggatgaccactattgacatttctaatgaaaattatagtagaggacttatccaatgcagtaagtcaaggaaaaaaaaatgaaatgcgtaaagattgagtagaaagaaataaaactatcattttttgtaaatgacatgaatgtatatgtagaaaatttatatatactataaaattaataggggaaatttgcatggctcagtaagttaacatgaaaatgaattttatttctattatgaacaagcaagatataaaaaatgatgttattatttaaaatgccatcaaacttctcaattacctaagaataaattgaaaatggcacaagatgtatgcacaaaaaaccattaaacgttgttgagaaaaattaagatataaaaatcctgagggatatagcatgttcataccttgaaagattcaatattgtaaagatgccaaccctcttcaaatcattgaatgattcaatgtgatccctttcaaatatcagcaggttttttgtgtatatctacttgtgtgtgtattgtatgtgtgtatccatgcagacataacatgtttacctggaaatataaaggacccataattgccaagatgatttttaagaagagcaaaattggaggacttgcgcttatgatatcatttattttgaatgagtgatatcagcaatatctcagaataggactttccaacacttgtctccttagagaaacatcaatctgaacacctatgcaagcacaaaagtatcttcagaagagttaagaaatctaggtgagagattatggcatctgagtggagcacagaagtaagaaaagatgcattgaaaacggtagaaaggacagttttacattacttgcatcaccactcccccaagccaaggcagtgcaatgtggagagagatttcctgtatatgagagaaggagaatgcagtcagcacctgatttcacagtggacaccagcactagacccatttcagtgaacttcagtgccaagctagcctatatggctccagtttccaggttcagccctgcagacccaggcaccaggcctaggcctaagggcccacgtgctcgacctactccagtgaacactggcctcaagccaacccctatgaacacaggaccaagaacattctcatgaacaaagtacaagcctgccccagcatcatttagttcctatggactcaggctcaaggccaatccaatgttggctctcacatacccaagcttcagtctaggccttgtggacgcagactccaggcctgtccagtagactcagttcacccctgtggaccttggcaccaagccgatctccgcagacccaggatccaggtccatccttgcctaagcatgaggtttatgttttaactccaattgctctaaccccagtggatccaggctccaggattgctttcatgtactcaggcaccagttcagcccctgtgggtccagatgtcaggccagcccacctgctgaccaagacaccaggtcagcctacccaggaactctaagcaataaggctgactgtactctgccaccagatggcctgcacagaatctctggataggttgactggtaaagggatttccttgccaaagccagtctgtaaagaatgtaagaggcgcctgcttcaaatgcacagacaccaatgcaaggccacagggatcattagtaatcagtgaaatacggcaccactaaaggaacgaaataaagcaagagtaagtgactcaaaggaatggagatggaggagctgcctgacaaaaaattaaaaataatgatcttaagcaaattcagtgagctacaagagaacacagacagctgaacaaaattaagaaatacatttacaaaatgagaagttcaacacagaggtagaaattataaaaaagaactaagcagaaattctggagctgaagaatacaatgactaaaccgaaaaattccatagacagcttcgatagtagacttgctcaagcaaaataaagaattagtgagcttgaagatagatcatttgaaattaaccagttaccaattactcaaattcagaatattgaagagaatctaaaaggaaagataatgagaaagagtgaagaaagcctgtggaacttctcaaacaccatcaagcaaactgatatatgcagtatgggtgtcctagaaggggcagagaaagaaaaagaagcagaaagcttatctaaagaaatgatgacagaaactttccaaatctggagaggaaaatgaatgctcaaatttatgaatcccaaataacctcaaatacattaaacataaagaggtttcactaagatacattataatcatattctcaaaagtaaaaggcaaagagaattttaaaagcagcaagaagaaagtttccttaggtgcaaggaaacctttttggttttttagagatggattcttgttaggttgctcatgctggaatgcagtggctattcacaggtgtgattccactactgatcagcatgggaattttgacctgctctatttccaacctgggccagttcactcctctttaggcaacctggtggtcccccacttccaggaggtcaccatattgatgccgtacttagtgcagacacctaattggcatatcatataacaccccagaactcctttgctcaagcgatcctcctacctcagcctcttgagtagctggaactacgggcatgcaccaccatgcctagcacatacaagggaacttttgcaagactatcagtggatttctcagcagaaactttgatggccaggagacagtgggataatatatgcaaagtgcttaaagaaaaaacctgccagctaagaatactatatctgaaaggctgtccttcagaaatgaagcaaaataaagacttctccagaaaaacaaaagctgtgggaattcgtagccactagattttccttacaagaaacactgaatggaattcttcaagtcgaaacaaaaggacataactaatgacataaaatatgtgaaagtggctgggcgtggtggctccctgtaacccccagcactttgggaggctgaggtgggtagattacaaggtcaggagatcgagaccatcctggctaacatggtgaaaccccgtctctacacacctagccaggcgtggtggcacacgcctgtagtcccagctactggagaggctgaagcaggagaatcacttgaacctgggaggcggaggttacagtgagccaagattgcaccaccatactccagcctgggtgacagagcgagactctgtctcaaaaaaaaaaaaataaataaatgaaaaaaataaataacaaaacaaaaacaagatgtgatagtacaaaactcactgtaaatataagaaaatagtcaaattcagaatactctaatattgtaatggtggtgtgaaagtcattttgaattctatataaagcttacaagatgaaagtattaaaacaactaaagctataataatttgttaatggatacacaatatacaaatgatataatttatagcaccaataacaaaatgtcagaggagggaagttaaaatgtagaatttttgtacgtggtcaaagttaagtacttaaacagcttaaaatagactgttataactgtaagatattttttgttagactcatggtaatcacatagaaaaaacatgtagtagataaacaaaaaaatgaagagaaaggaatcaaaatataccactacaaaaaaatcccatcataaaggaagaccaccagggaggaagaatgaaacaaagaaactacaaaacagtcagaaaataattaaaaatggcagtagccagtccttaacctgtcaataattcctttaaatataaatggattaaattctccaacaaaagacatagagttgataagttgatgaaacccacaatccaactatatgataagagactcattttagctgtaaagacacacataggctaaaagtgaagggatggaaaaagatatcccatgcaaatagtaaccaaatgagagcagggttggctacacttacatcagacgaaatacactttaagtgaaaattgtcataagagaccaaaaaggtcattatgtaatagtaaggggtttaatatatcaagaggatataacaactgtaaaaatatgtgcacaagcaatagagctcttaaatatataaagcaaatattaacagctgaaactagaaatatacagcaatacaataataataagaggcttcaatactccactttcaaaaattgatagattattcagacagaacatcaataggaaaacagtggacttgaacatgatagaccaaatggacctaacagacatatagcatattctgttcaacagtagcagaatacacaatcttttcaagaacacatggaacattctccaggacagatcatacattaggccacaaaacaaatcttaacaagttttagaagattgaaattatagcaagtgtcttttctgactacagtggaatagaactagaaatcattaacggaggaaaattggaaaatttagaaatatgtagaaattaagtaatgcattaatttccaaacaactaataggtcaaagaagaaaagtatctcaagccaaatgaaaatagaaacatatcatactaaaatatatgggatgcaacaaaagcagtcctaaaagtttatagcagtaaagtcttacattaagataaaagaaaaatctcaaataaattatgtaattttacacctcaaggaactagataaagaagagcaaactaagccgaaggttaacacgaaaagaaagcaataaaaattagagtagacataaatggagactagaaaaacaataagaccaacaaaaataaaagtttgttttttgaatgcgataaaatagacaagtcttaagctaatcataactaagaataaaagagataaaacaaataaataaaattataagtggaagagaagacataactgataccacagaaatacaaatgattgtgacactatttccagtaattacatgctaacaaactggcaaacctaaaagtagtgggtacattcctagaaacatacaaccttctgagatttgataatgaagaaatagaaaatctaaatagaccaataacaagtgacatggtttggctgtgtccccatccaaatctcatcttgaattgtcattcccataatccccacgtgttgtgggagagacccagtgggaggtaatttaatcatgggggcagttaccttcatgctattctcatgatagtgagtgagttcttgcaagatctgatggttttagaagggcttttcccccttctgctcggcacttctccttgctgcctccatgtgaaggatgtgtttgcttcctcttctgtcatgattgttaagtttcctaaggcctccccagccatgcggaactgtgaatcaattaaacctctttcctttataaattactcagtcggaggtacgtctattagcagtgtgagaagggacaaatacaacgagtaacaagattgaatcagtaataaaaaatctcccaacaaaggcaagcttgggacccaatgactttactgatgaattccatcaaacacttaaagagaaactaatgccaatcgttttcaaactcttccaaaatgttgaagaggaggaaacacttccatacttactctatgaggccaatattactctgatatccaaaccagacaagaatgctttaagaaaataaattacaagccaatatttctgatgaacataggtgcaagaattctcaacaacatattagcaaactgaactcaacagcccattaaaaacatcacacaccatgatcaagtgagatttatcagtaggttgcaaggatggcttaacatatgtaactcagtacatgtgatacatcatgttaacaaaatgaaggacaaaaaccacaatatcttcttaatagatgcggagaaagcatttaacaaaattaatcatccattcatgataaaaactctcaaaaaataagtatagagagaatgtacctcaacctaattattttgataaacccatagctaacatcatattcagcagtgaaaacctgaaagcttttcctctaagatcaggaacaagacaggaatgctcattcttatcacttctattcaatataatactgaaattcctagacagagcaattaggtaagacaaaaaaaaggcatccagcctggaatggtgtctacactaagcttggcatcaatatggtgaccttctggaagtggagtaccaccaggttgcctaaggaggggtgaactgacccgggttggaaatcgagcaggtcataactcccatgctgatcagtagtagaatcactgcactgttcctttttgcaggtgacataattttatatatcaaaaatcctaaacacttcatcaaaaaacttttagaactaataaagtcagtaaatttgcaggacacaaaatcaaagtgcaaaatcagtagcatttctatacactgacagtgaactatcagaacaagaaatcaagaaaattatctcttgtacaatagcatcaaaaaattaaatacttaagaataaacttaaacaaggaagtgaaatatctttacactgaaaattataaaacattgatgaaagtatagaagaataagtggcaatatgtcccacattcatggtttgaaaaaagtaatatcattaaaatgttcgtactacacaaaactatctacagattcaatgtaatccctatcaaaattacaatgacattttcacaaacattagaaaaaaatcctaaaattcatatagaactacaaaagaccctgagtagccaaagcaatcttgaataaaaataacaaaggtggaggcatcactacctgatttcaaaatctactatgaagttatagcaatataaaaagcactgacaaaaaaaacaaacatgtggaccaacggaagagaacagagagcccagaaataaatccagacatttacagtcaattggtcttttacaaagatgctgaaaaccaccaatgggagaaatgacagcctcttcaataaatagtgttggcaaaactagatgtgttagttcattttgcattgctataaaggaatacctaagactgggtaatttataaagaaaaaggcttacttaggtcattattctgcaggctgtacaggcatggtgccagtatcttcttgacttctgtgagatctcaggaagttttaactcatgatagaaggcataaggggagcaggcatgtcacagtgaaagagcaagagagagaggggagaggttccagagtctttctaacaaccagattttgcatgaactcattaccatgggagagcaccaagtcattcatgagggatttacccctcatgatctgaacacctctcactaagccccacttccaacattgcaaatcacatttaaacatgaggtttggaggggactaacatccaaaccatattgctagatatccacatgcaagagaatggaattgaacccttatcttaaaccatataaaaatcaactcaaaatggatgaaaggcttaaataaaagacctgaaactgtaaaactacacatagaaaacacaggtaaaagcattttgatattggactgggcaatgattttttggatatgatcacaaaagcacaggcaatgaaagcaaaaataggcattgcatcaaactaaaatttttctgcacaacaaaggaaacaatcagcagagtgaagagataacctacagaattggaaaaatatctgcaaaccatacatctgatcaggggatcatatccaagatatgtaagaaactacaacaacttaacagaaaggaaacaaagaacccaatttaagtgtgggtgaaggacccaaatagacatttttcaaaaaaagaaatacaaatggccaaaatgttcatgaaaaaaagtccagcatcactaatctttagagatatgcaaatcaaaaacacaacgagaaatcacctcacacctgttaaaatagctataatcaaaaagagaaaagacaaaagttggcaagaccgtggaggaaaagggaacatatactgtttgatgggaatgtgaattagcacagtcattatggaaaacatgaatgtttctcaaaaaattaaaaataaaactaccatatcatcccatagtctcacttctgggtatatatctaaaggcaatgaaattaatatctgaaaagatatctttaccctcatgaatattgtagcattatttgcaatagccaagaaatggaatcaacctaagtgtccatcaatggatgataaaaaatgaaaatgtgcagggtatgcgcacacacacacacacacacacacacacacacacactcatatacacgatgaaatattcagctttaaaaagaaaatatttgtgacaatatggatctggaaggcattatgctaagtgaaagaagctagccacagaaagaaatattgcatgatctcacttacatgtggactttacaaatgtcaaactcatagaaacagagtagaatggtaatttcgaggggttggatgttgaaggatatggggagacttggtcaaagggtacaaagtttcagtttggcagggtgaatatgttctggagatctactgtacagcatgataattctagttaacaatactgtactgtatgttaaatttgctgagagaatagatcataaatattctatcacatacacatgcacacacgataactatgtcaggtgatggatatgttaattagcttgattgtggtaattatttcaaaatgtatacataatatatagcatgaaagcatcatgttgtatgccataaatatatacctttttttatcaattatacctcgagactggaagaaagggaaaaatatttatttcaaagttgtaataattaatacagtatgatattggcacaagacaaaatatgcatggaacaaatagagaaccagaaatagatccaaacgtgtgtatccacttggcttgtgacaatggtgacaccgcattgcagtgcagagaggtcattccttcaataagaggaagtcatattgggtcgattggatagtcacatggaaaaaaacgaatctggagctgtatcacacatcctacacaaaaataaattccagatacattatagttttaaatgtaaacagtaaaaacaacaaaatgttgtaaagataaatttgggaatattttcattactttagagtagtttaatatttcccaggaaagatacaatactgcccataaaaagattgttaagttgatcttaattaaaattaagaatttgtatttatcaaaatacaccattaggagaataaaaatgcaagcaacagagtgggaggtatttaagatacatttattcaacaaggggatattatccacaaaatatttaggaagtgtttctacaaatctgtaacaacccaattggagatgggcttaaaacctgaataggctcttcacaaaagaggataaaaatagccgataagcatatgaaacaattttaacctcattagtaattagtaaaatgcaaattgaagtcacaataaggtgccaagtgttggtaagaatgtatttagaactttcatactcttgccttatgcaatgaatccctcaatcataatactgaatgaaagcaaacacaaagatatcttttacatgaagttttaaaacaggtaaaactaatggtggaatatgtaaaaatggctgttaatttttatagagagcttgagagagaacacaaagaagcttcaggggtgctggctatattttgtttcttgatctggatagtaattacatgggtttatataatttttttttgcatggtcacatttttacatgcttgctattctatattaagcgttcatttaaaataaaatcactggcccggtatggtggctcatgcctgtaatcctagcactttggaagcccaagatgggcagatcacctgaggtcaggagtttgagaccagcctggccaacatggcaaaacctcttctctactaaaaatacaaaaattaaccaggtgtggtggcacacacctgtagtcccagctacttgggaggctgaggcaggaaaatagcttaaacccgggaggcagaggttgcagtgagtggagatcacgccactgtactctagcttgggcgacagagtgagactctgtctcaaaaaaacaaaaaatatatatgtatatataattaaatcactattaagaacttcagacagttgttgggagaaaactgccttagtcttccaaagctcaggtttttgcctagtatgtgtaatccaggggacatccaacagtgtgtctggggagggacagtcttgtccccagatctgtcaacattttttcattataacaaagcccatatgactcatgtataaaactctgaatgcaatgttcttggaaatatgacaaggtccaactgcctagttctcccaagcagcagcattacttgtgtatgtgagagagggatgaggaagtggggaggagggagattctgtttgccaatctagaccagtgttcctccaacttttttgaaatagagtttcactctttttgcccaggctgcagtgcagtgatgcaatcttggctcactgcaacctccacctcccaggttcaagtgattctcctgtctcagcctcccgagtagctgggattacaggtgcacaccactatgcctggctaaattttgtatttttactggagatagggtttcaccatgttggccaggctggtctcaaactcctggcctcaagagatctgcctgcctcggcctcccaaagtgctgggattgcaggcgtgagccactgtgcacaactttttagtatacagtgcagtcacatggagggtttgataagacaaatggagtggaaccactttcaaagtttctgattcagtaggttgagatgggcccccgaattttgcatctctacattcccaggtgatgctgatgagaatgctactggtatcatactttgagatcaactgatctagagcacttattgatgagcactttacggagacagcaaggtggcactggtggtggggtgatggtaactggatcataggtcagagattcagccattaggctcagattttattgttcacagcaggttctatgtaaagactctccttttcccagaactggatttcatgagtttattgcatgagtttttacaagagagttcaattacaatacaccaatgccttattcttgcacatggcaagtcaatatgggcaatatgttcattgaacatccttccccactcatgatctcattaggactttggcattttaaatagttcagcttgtaaacccagggccatctgtgcaggtgacctaatccatgtctctgatgataactagcacccatagtaaaatgaatgcaaactgatttcaatttctgtttaaaaaacaaacgaaaccttactttatacttggcattagcaccagtgttggaggcagggagtgtggtggaaatggggagggaacaaagaagcagcagatacagctgcctgctttcctgtcatgaggtttactttacagtacatcatgtgtctcaagaccagctgagtgttacattttccatccttaaatgacacttgctttgcacatgtatttcaaaggcttagagttgtttgcagaactctgtcccaaccacaggacttcccatcctgcagctggagagtcttacatgcagaagggcctgggactttccaagtgtggggtgtcatatctagcagctctcctttctcatctcttgggtttgacttgtcctgaactaccccttgctatagactagccacagtggcgtcatctgtttagtctggacactgctatcatctttggcaccccagtgctccctggtctgtttaccttaggcagtattgccagctaaagaattgctttcccctgctctcatatccatccacagtcaccaatagggttcgctttcccatagacctgctctatgttggtttttatcagctaagataatccaccttacgggctggcagcagaggccactggtgccctggctacatcctcaccttccagtgtgctctgactggtttccagttgcatctgcatctctgtgcctgaggattcccccatttcaaccctgaaccctgaaagattgctctgcctgtttgtacaacaggccagatgttccaggaagatcccttaatcaatggctttcaggcactgatatatgaatatcccagattatttgcttctaggctgatgtaattctggtatgattagcattatttcccagaattttcccatggtagctggcttaaaaacacatgtattggcttccttccaaggaatttttatatttgacagctatttactgagtgcctactgtttgccaggcactgtgctagatttgggatataaatgatgagtaaagcagatgtggatcttgtgatatcgtgggagaaacagataataaacaatcactcactcacaaatgtatcattttaaaattgtgataagtgccattaggactcacacaaagtatatgatgaaggaactgagtgtcttacctacatgatgcagtgactgggtaaggctgcattgaggaggtgatttgaactggaggcctagaggatgaaaatcagccatatgcagagctggggaataaaatgtgcagatattggaacgggaaataatttaggatgttcttggaatggaaggagagctgacagaagaggggacagtggtactcaggttggataggcaggtaggcaccagatcatccatggccttgtgaagcgcctaggtgggtggtatgtgtgggcatgtgtatatgtttctgtatgcgtgtgaatgctgtaacatatatgtgccttcttctctgtgtttgtgttcacccagtggtatgttagtgaatgggatgtgtttgcatcttgactatgtgtgtatctgtccgactgtgccactgcatgtgtgggtttttgtgtgtatgaaggcctgtatattgatgttttcaaatagacttttttgatatgtatctataagtatgtattaatatatttttactatggtgatatctaggtctgtaggcctaattatttatgagtatgtctataaagatatatagataaatgtgtcattgtgcatgaaagcatgcacactgatatgtatatttgagtgtaaatatatttgtattatggtattgtataggtgaatttataggtgcctgtatatgtgtgttttatgtgtatatgattaaactagaactagattgaacaatattctgaaattagtgtctgtgtctctgtatgaagctcaggaaatagtctttccctcaaccagaccacaaaaacttggaatttttatagctcacatttgctagcaagatgcaaactttacttgcagttacagttatggcttgctttattttacattttcaatattcctggcctttaagaatctgaattctaaatactttatgtgaatgagtgaatatgtgtgcatgtgtttaattctcttggtttcagtaagtcagcttcagttaggccaaaatccttacccttgtctttatgcgttaatatctttatttagaaatgaactttagacctggagtcgagtggttgcctcaggcagcttttttttttttctccattaatatcttagttgtaagatgatccagcagtttgattgtcggggaatcaaatacaaggaggccatccttgagccccatggatgttcttatagactgatgttgtcagagaaatggagacagcaacttccagggaaagacaatgagcagctagagtctgagctactatctccatatagagtaagtgggcccagtcctttgaatagattttccttcaattcccgattctggcagcacacaaaaaaagattgttgcctagtcatgggacacaggctttggcatgactatttttatccaggcaatatctcatgtttggtgctctatttattcttccaactagaattgtggtgtgtgatgatgcccttaaagatcatccattctagtctactttacaaactcttctttcatgggtggacattaggctgctccttcaacacctctgtggtagattgtgttgatgataggcccaattaatggcctctctgtatccatgctcattgtattttaactttgtagttccctcccactttgcctctgggattagttctgtgacttgctttggccaatacgatgttagcaaacttgatgcaagcagaagtgcgaaaaaacacctgtgagtttttacttcctctccctctcttttctgtgatcaccctaaaaataagcccacactagcctagtggaagatatgagaccacgtggagaagagctgagttaccccagctaaggccatcttggattagttatcctttagcaagcctaaaggctaaggatagatgcgtagtgtgagcacagccaaggtcaattcaactaacccatagattcaaaagagttaataaatggttgttactttaagccactcagtttggagatggtttgatatacagctgtagctaactgatataacctcaatggtagggtgcttattatcactggaggcagtccatttcattgtgtatcaattctaattgttatgcggtggagctggactctgcattataacttctgactatgccctgtgagtgtcagtggaaaaagctcgtatcttctcccacaatgaccttcaagtatttgatgatagtgatcatgccagatgactagagcagcttccaaactaaattatccacacagaagttatccttgttaaacaaactggattatgttataccttgctaaaaacctttccatagtttctcattacacttagattaaaacccaaacttctttccattgttctgcatcatccatatctgtttgtctcaacctcatcctgaaccactcttgcctttgctcatgatgctctcatcatatcgacattctttatgttgacagtgctaagctttttctcacttgatggtcttttctcatgctattccctcctgcctaggaataaatatgtgttgacattcctgaatcttctcttctctgaaccaaacatcttctgtgtctgccattattcttcaattgatataaatgtaggtcttctcactaatctgattgcatgctttagtgtcttgttgcctcattttgaatatgatacccagaaatgaccatacttcttgggcatgactacagcaagaaagttatcttgttctttctgaaagaagtctacatgcacccaaggtatcgtgccaccaggatagaaagaaccatgcacattcacttatgatggattggctaggtggataggatgacgaatgcttggaaaacagactatctggcttctaccaggtcaatggcaaagaccttgtagcctcctaatatataagaggttgatgtgtacacagattgacaggacagacaggaatagtcaccaaggatttgtcagtggtttcccttgagccttgccctagagatcagctcaatctagagtgggttggagtaagctattgtgtgtctattagcacagaggccaaagcccttctcagctcctcagttctatgtgaatctctcaccttcaatctcatcctgaaattagtttatctttaagtcatagataaatacaaagtctaacaataggctagtaaaagtcaagtaatagtaactcataattgtggagcatgtactctgacacaggttctttctaagcacttaatttgctttaaccaatcaaattcttaaaacaacccttttaggtagaactagattaaaccagttgtttcctaaccaactgcacagtagaatcaccagaggagtttgttgaaaaatggaaaaataaaaacaaagcaagaaaagattacctgactctacccaatattgtttgctaaatcacactttcttggggtggggtgggggcagggggccaagataatctgtgttttaaaaacagctctctgcttgctccttcagcaattaacctggcatctgtgagctggcatttgggaactaataaattatgtcagcctttcccatagtatgcctcacaagatgatcataggtggcatacagaacattttttaattagattttaataattacatatttatttttaaatatgtgcatgagaaaaaggtagcatattgaatctgtgtttttatagatattgctgaggaaaggcttaaagtgggtatttaagttaaaaaaaaaaagtgagttgatttagagaaaattaagtagtgaaacaggtatactgataaggttaacactcaaaggtggcaaatgaatggccaaagtttaggatactctgagaaaattctgagatccctttgattcagtgattctttcattctatgtggcatgtggctttgggtaaatatgcaactttgcatttgaatttgcttatatgaacactttatcagtagttttcaaactttcagtagcagaactttttcaaatggaatctctcttacccctgaactccccaagctatctcaccccaagatttccttcagtctcagctcctgaaacctgacctaaattaaatcctagctcttgtcttacacaaggaaatggaagcaagggctaacattgatgcagctttgccattcaaaatgtgctcgacagtaaatcagctttctaagggcatgagcgcagatttgcattttggatgttgaaatgaaatgaagatgacctgtagaaagacaggaattggagttcaggtggggataggatgggcctagaagactttattctctttctaatagcaattcacctctttttcttccaaccttagtcatgcgcttctagttctacctttatcagcagtgagatttcctcaacttccttaatctcagtatgattccacctataaataaacattattatgggggccagctcatagggttgctgtgtgtattaaataatatatattcttacctccaggtctggcatatggtgtttgctaagtactagttactaccatctccaaagtcattttagcatcaaagataaatgcatgttaattgtttaacctccagtaaatataatttaaaacaagtaaaatataatcaattatctatttcatgtatagctttgagtgtttcatttttttgaatacaaaaatgtatatgaccttcaatgggtttaataatattcttactttccttaactccttaaccttatttgcctcatgaggcattcagttctgtcatgaaatctctgaccacagatatatttcaggaggccaatcttagcacttggagaaagcttcttttaaaattcatcacgtttattgagcaattttccattctctcacaaagctccctactacttaatctcacttgagcaagaaaatattcctgtgaagtgggtagggctgaacttattcccattttacagatgattaaactgaataagctttggaaccatctcctttggaagcaaagtaactcactatggtctaaacactttgagaaaagagagaagaaaattgagatgaattcatgctttgcctcaattccctgtatctttcatgttaaattaccttgcttcatgttattgctgcaaatttggctttgttagtgcagacctgacctggatctgtctatatttctgcatagagagatgaccttaatgtatttgcagaatctacatgctgtccactaaaggccacccagcaaatgcaaatgtagcaaatggaaaatgcatttcaggtgcaggtcaaaaactgtcccagcaagaaaaataactgcaatgacggggactctggctgtccagataccttctgaaagtctctttgaattaaaagcagagcgtctgacaatttcatgactaccccatctgaaaatgcagtcttccctgaggtggagggggtgatctaggtcactgacttgccctgccagaatcttaccaacaaaaaggtatcagttgactgagtggaagtgacagggactttgggaaaggtgacagagtgagaagttaggaactgggcacagttagaagacaggaatatggattgcaaacaagtgaaagaaaaaacacagctcaaatttgtagggtggtgcttcaaaaagtagtgtgactatgactggaaatctcctcaaagtgccgttctgcctgtgcatattttcccagtgacaaaggtcatggagtggtaaccagagaaatccatgcagtgagccagggaactctgtgatgaaagtgaatgcaaaaatggcacctgagagatggaaagaaggactcagaattaagaacaaaatagaagaggtggaagggaccaagaagactgtgtcgtggcagggggtaaagctcacccctatgctgagggttaaaatatgttaaggaaagaaaaacaaacaagcttctaaaaatcatccgggtccagtgtggtgactcacacctgtaatcccagcactttgggaggccaaggtggtaggatcacttgagcccaggagcttgagaccagcctgggccgtataacgagaccctgtctctatgaaaaatataaaaaaagctgggcatggtggtacatgcctctagttccagctgctaaggaggtcgaggctgcagtgggccaagattgcaccactgcactccaggcctggggaacagagtgagaccgtgtctcaaaaaataaataaaatgaaagtcatgtgtcagagaagcagatctagatctagatcctagatctctgaaggaataaataggttttctggtactgaggagggagctggaaaaagagaatttaagcctgaaaagtgtggagggggctttaatgagggagaggaggtacaacctctcaataggaggaagaactagacgagagaatcttacttctcttgcgagctcacttctcatagtctcctcaggttctgagaggacttagggttgggatccttgagtatcgctaacgaactgacagaattgatggagaagaggtgagagtggtagaagatgggagaaaaatgtcatcccaaatttcaacagaggaggaacatagcttccatgaaccactaggtgagtagtttgctgtagatccaaaaggaggttatggaatggattattaaaggagtttgtttgtgaacacatggagaaggaaataataatcacagggactcagcatgtgttttcccagaagtcatatcaggtcaatctcatttttccttttaccccattatgtaatgacagacagattaaggaagtgagactgttgctaggatctaggagatcagctagacatttgacaaagtatcacataaaacctttttggacaacatggataaatataggtaagaagacaaatagtaatagttatagtaataataataataataataataacaacaacaacaaacacttactgagtttttactatgttagaccatgtcaggattttggtattctttgaactatcaatcacaaaataggctgctgtcaactagaagagaggtctccagtggtgaacccagcattgtgtgtttttgatcctattcaggtcagcacattgattcctccctcttctaataccttggccttatccatggtttcaatttggttgatgaacatttattgccaatcgaaaatagtcaactcccacggtactcttggcactcgggtacagttgagtgctagaggtaggctgataggttcaaataaccagtttggttatttaccgtctatgtgaccttagtcaagttactcattgatatggttaggttttgtgttcccacccaaatcttatctttaattgtaacccccatactccccatgtatcaaggaagagaacaggtggaggtaattgaatgatgggggtagttcccccatgctgttttcatgatagtgagtgatttctcacgagatctgatggttttataaggggctcttccctcttcgctcagcactcctttccctgctgccttcaccttctaccatgattataagtttcctgaggccttcccagccatgcagaactgtgagtcaattaaaccactttcctttgtaaattacccagcttcacgtatttccttacagcagtgtgagaatgtactaatacactcactgtctccattttttcatttccctatctgtatgatgtgtgaagatattagagatgttatgaaaattaaaggagacaacaaaagggaagtaagtgcctgacaagggtaagtgtgacaactggcatggtgtttgcctttttggaaaaatataatataacctggaggttgatcacctgcagagaatacagaggacaatgaatgacaaatggctgggagggagggaaaacaaacacaatggggacagtcagaaatgaacaaagagcttgacaggaaggaatggtgggctgaatccagtatgatagaaagtaccaggagaccagcctgaccaacatggagaaaccctgtctctactaaaaaagaatacaaaattagccgggtgtggtggcatatgccggtaatcccagctatttggaagactgaggcaggagaatcacttgaacctgggaggcggaggttgaggtgagctgagatggcgccatttcactccagcctgggcaacaagagcgaaactccatctcaaaaaaactaccaggaataaatgtttagctaaaaaattccttccatttcaaagtagaatatgggagattggttaagcagttactcagataaagaggattgtgatttcagaagatggcacagtttgagtcaaaaatgagaaattcccctggccaaaatgtggtaatgagatttcaggttatattaatagaagtatggtatcttcactgtggaggtgctggtcctctctggggcaccaatcatcccatagctagagtattgtgtttgggttttagtaacattacaaatatgggtggggttatcatctgtccaaatcagttctctggtgtcagttatttaatggtttcccatcacacttaaaaatcatatccaggctgggcgcagtggctcacgcctgttatctcagtgctttgagaggccgaggcgggtggatcacgaggtcaggagatcgagaccatcctggctaacagggtgaagccccgtctctactaaaaatacaaaaaaaattagccgggtatggtggcgggcacctgtagtcccagctactcgggaggctgaggcaggagaatggtgtgaatccgggaggcggagcttgcagtgagtggagatcgcgccactgcactccagcctgggtgacagagcgagactccatctcaaaaaaaaaaaaaaaaaaaaaaaatcatatccaaaatcctttccatggtctacaaggtgcttttagtctctctcctccccatcccccatctgctacctcatttcttactacttcatccattagcttctgttgctgatcttcaagcaggctaagtgtgttctcatctgaaggctttctcacttactgtctcctctacctaaacacattttccccagaaagttctttggcttgatccttcacttaattcaggtctctgttcaatgctaccttctcaaaaagagacatttctaatactttatctaaaaaatgactcaatcactgtttcttcatgctgtttcatttttaaacaaaacggtattctagacggcagggtactccaacagacctgcagctgagggtcctctctgttagaaggaaaactaacaaacagaaaggacatccacaccaaaaacccatctgtacatcaccatcatcaaagaccaaaagtagataaaaaccacaaagatggggaaaaaacagaacagaaaaactggaaactctcaaaagcagagcgcctctcctcctccaagggaagcagttcctcaccagcaacggaacaaagctggatggagaatgactttgacgagctgagagaagaaggcttcagacgatcaaattactctgagctatgggaggacattcaaaccaaaggcgaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcgatagaagatgaaatgaatgaaatgaagcgagaagggaagtctagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacactcttaaagaaaagaattttcaacccagaatttcatatccagccaaactaagcttcataagtgaaggagaaataaaatactttacagacaagcaaatgctgagagattttgtcaccaccaggtctgccttacaagagctcctgaaggaagcactaaacatggaaaggaacaactggtaccagccgctgcaaaatcatgccaaaatgtaaagaccatggagactaggaagaaactgcatcaactaacgagcaaaataaccagctaacatcataatgacaggatcaaattcacacataacaatattaactttaaatgtaaatggactgaatgctccaattaaaagacacagactggcaaattggataaagagtcaagacccatcagtgtgctgtattcaggaaacccatctcacgtgcagagacacacataggctcaaaataaaaggatggaggaagatctaccaagccaatgggaaacaaaaaaaggcaggggttgcaatcctagtctctgataaaacagactttaaaccaacaaagatcaaaagagacaaagaaggacattacataatggtaaagggatcaattcaacaagaagagctaactatcctaaatatatatgcacccaatacaggagcaccaagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacggaatatacatttttttcagcaccacaccacacctattccaaaattgaccacatactgggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattgaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccaccgatcccacagaaatacaaactaccatcagggaatactacaaacacctctacgcaaataaactagaaaatctaaaagaaatggataaattcctggacacatacactctcccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaaccaaaaaagagaattttagaccaatatccttgatgaatattgatgcaaaaatcctcaataaaatactggcaaaccaaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaaggggcaaaaactggaagcattccctttgaaaactggcacaagacagggatgccctctctcaccactcctattcaacatagtgttggaagttctggccagggcaattaggcaggaggaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcataagcattcttatacaccaacaacagacaaacagagagccaaatcatgagtgaactcccattcacaaatgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctcagccaaaagaacaaagctggaggcatcacactacctgacttcaaactatactacaaggctacagtaaccaaaacagcatggtactggtaccaaaacagagagatagatcaatggaacagaacagagccctcagaaataatgctgcatatctacaactatctgatctttgacaaacctgagaaaaacaagcaatggggaaagcattccctatttaataaatggtgctgggaaaactggctagccatatgtagaaagctgaaactggatcccttccttacaccttatacaaaaatcaattcaagatggattaaagacttaaatgttagacctaaaaccataaaaaccctagaagaaaacctaggcattaccattcaggacataggcatgggcaaggacttcatgactaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaaaaagtgggcgaaggacatgaacagacacttcagaagaagacatttatgcagccaaaaaacacatgaaaaaatgctcatcatcactggccatcagagaaatgcaaatcaaaaccacaatgagataccatctcacaccagttagaatggcaatcgttaaaaagtcaggaaacaacaggtgctggagaggatgtggagaaataggaacacttttacactgttggtgggactgtaaactagttcaaccatgtggaagtcggtgtggcgactcctcagggatctagaactggaaataccatttgacccagccatcccattactgggtatatacccaaaggactataaatcatgctgctataaagacacatgcacccatatgtttattgcggcattattcacaatagcaaagactcggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaactgaacaatgagatcacatggacacaggaaggggaatatcacactctggggactgttgtggggtggtgggaggggggagggatagcactgggagatatacctaatgctagatgacgagttagtgggtgcagcgcaccagcatggtacatgtatacatatgtaactaacctgcacaatgtgcacatgtaccctaaaacttaaaagtataataaaaaaaaagttgtatttagatatcattactgctttaatacctaaaaaaaaaaaaaaaaacaacggtattctacatatctatgtgtcttttattatctggttccctcattagaggaggcactatgaagggtagggacttaactgttccggtcacagtctagcacagtatctggtacaaggaaggctcatagtaggtgctcagtgaaaaaattgttgaacgatgaatgaataattaaataaatgaatgaattaataaacactctgtagaactcacatttcatagaagacattttggcaaaagttatatgaagtttttaacttgtctattctggaaataaggcagaagaaaaagtagggaagtagcaaagatatgggacatttgtctaaattttgtaatggctatagtttttaatctcttttttttaagatggaatctcgctctgtcacccaggctggagtgcaggggtgcgatctcagctcactgcaacctctgcctcctgggttcaagtgattcttctgcctcagcctctcaagtagctaggattacaggcgtacaccaccacgcctggctaattttttgtatttttagtagagacggggtttcaccatgttacccaggatggtctcaaactcctgaccttgtgattccctgtcttaagatattcctaaaattcctccttcttaggagttctctttccttggaacctagagataagtcgtcctcttatctttgggacacttctaggatgaagacactcttatgtgatgttgctcactttcctgcacctcctctgagccctgaccccataaggctgattgtcccccacatccccttctctctgttctttggggttcttcaggattgcatttactatctggttgtcctttgggagaagtggcagattattgtctatccacccttgcatatatgtctcccagttttacaatgccaataaatttcttaaatacattttaaaatacaactcttttattgtaagaattatggctgtcttgtgtgtgtgtgtgtgtgtgtgtgtatgtgtgcgtgtgtgcacacgcacatgtgtttatctcacagcatttaacacaaagcctggactgtaacaagaactgagaatatatttgaaggttttaagaatggtttgagaagactttttggttaaaaaggtaattcagatatacagaagtgttttttttttttttttgagacacccattcacaaatgtgcctttcttccagaggcattcatttattcatccatccgttcatttaacacatatttactgcatgtccctatgtgctttcatgccctggtctcagcacatcctgacttgagccctgccctcacacagtttcttcacatcagcttggcaagaaaaaggggcaattcttgaagaatcacatgttttactcattgttccattgaacactgctcagagaaagtgtgattagaattatggagaaggggtaactgaactgagcaagtattaagtgtctcctcttctaatccctggacctcatccatggtttcaatttggttgatgaacatttattgccaatcaaaaatagtcaacttccacagtgctcttggcactcagggttagagttgagtgctagaggtagactgatggattcaaatcccagtttgtctatttaccgtcctgtgacctaagtcgagttattcacgttctccagtttttcatttctctatctatgctctgttacccccaccctccaatctttgggtctagcaacaccccccttgaggctttttctaatgctcaatgaacaacagaatttcatgccctgacccaactctcccctgctcaaaattaacttaaataataaacaatcaaaaatcatagaccatgagaaaacaagaagtgggaagatgttagagatgttatgaaaattaaaggggataacatatgggaagtgcctgacaagaataagtgtgacaattggcatggctcttgtctgtttggaacaatataatataacctggaggttagtcagctgcaggtaggagataattttgaatagaaaaaaatcttcaatgtatagtaaatttactttttcatagtcctaagtataaaggcactcagatgaagggtattgagaactctttctccaccatcaaaacccacaagatctgctatcattttaaccagtgtgtttgtgtgtgtgtgtgcatgtgtgtgtgtgtagaggaggaggacagtactttcttaacctcctcattcttcaaagtctttatccaattaatccagaaggtatgttgcttctatatagcaggcacatgttggaaaccaagtctcaagaattggaaggaattcctacatactcagtaattccttctcttccttcctttcttccctccttctttcctcctttcctttgtctctccctttctcccttctctcattatttaattaatggttaatggataacaacttggcagcaggcatctttactgtcctccttgggctcttacgttcatacatgtgggtcatggattatctaaaacagcgtccacaggagtgctgcctttttccatatgaccgaatcccttgccatcacctcttgctcagcacctcagccctttcagatgtgcaaccctactttgaatttctatcctttgggaaagaggaaccattatggattttaagcagaggagttatttctgaagattaactggggaaggaaagaggactaagacaggaggcaggaagagagaccagtccaagtttctaatcctagttctttccctacacaggtgtgtagccttggagaagttacttaaccttacaactttatttacttatctttaaaatggggggtaagaaaccccatctcacaaaattattacctgagttcagtgcgaaaacaagaaggtgattttggtgcctagtatgaatggagtgttcaataatgatttcacagttctttccttttctaacactttgtctttaagatgagaaatgagaattgagcctcactgttgttcacataagatcaaaatggctttattgcaagtaagcttctaactagatagaacccattgttttctcagggtctatgattcttggttattatttgatttaatttcgagcaggggagagttgggtcaggacatgaaattctgttgttgagcattgggaaaagcctcaaggagggtgttgctagacctgaaggttggagagtgagggcaagagagcagctgaaacacaaggagaagctgggtgctctgaacccagcaatttcactgtcagtaattctagctgaagccctgttcttggcctggtcccacctgcccatctataattaaggtcgtgtctacagttatacagattataaggaaagagaagaaggatgtcatcaagtcataatttccagaatcaaggctcctattttctccatctttttttttcctccctattttggatttggcagcaggtttcctaaaaagtaggccatcatgtccttttttacagttcattacgagtgggcaaggagggccccctcaggctgccaaggccttgatgctggttttctcaggcagcgagaagggagcgtttcctggatgctcacctctggccaggaggcaaacattggttatggaagaatttttccttttatttctaaacaagaggttgtaataaataaggaatcatttgcaaatgtttgcatatccagcccaattttatttttaattctacagtgcatgtgtgctgatgcatttttgatgtaggaaattgttacagatgtaaagttggaaaatttatttgagggtcttgggatttgaagattgcattggaactgtcagtgtcagcccttttgtgacagagttcatagaaggagaacatttgagaacaaaagagtaaatgaaaagtatttgatctaggctgtgactctgttgttaacattattttcataaaaataaccatagacctgacctggcagtctgtgaacacagaattgtttccttgatggagggtagcacagttaagaaagaggatgcctaaatcgtgggtcaaggaggtgaaaaatcagtaccccaggtgacacagtgctgagtgtggatgctatgttggctatgtattcctggttttgtttgtgttaagactcaggcttaaaagttataaagcaagttttgagctatatatagatgataagtagatattccctgaattgtgaaggtttcctttatatagcccaataattgtatatttgcgttctctcccatgtcccctttgattgactagtcttggctgcctgaaggagatcttttagggatgtctgatttggagatggacagggacagaagtggctcatgtattgtgtgcttgaccttctaacccaagagagtcctcaattgcaggcttacatccttcttggttcttgtggggtccccacatcaaccaaaggatgttctttctactgctgcctcttagacatcttcttctcctccttctcctcctcttttctttcctcttcctcctccttttctgtcatttccccctttcttttcctctttcacctgcttttcctttttctctaccctctctttctctttctcctttcctctctttcttgtcctagaaaggaaactcacttgtgccaaacacctgctaagtccttttacatatgtatcatcttatttaattctcaaccaattcttatatttagaattccatttggttacatggatgaattgtatagttgagtctaggattttagtgtacctgtcacctgaatagtatacattgaacccaataggtaacttttcattcctcactcacccctagcctccctgcttctgagcctccagtgtccattatgccactctgtgtgcctttgcatacccatagcttagcttccacttaagtgagaacatgtgatatttggttgttccattcctgggttacttcacttaggataatggcctccagttccatccaagttgctacagaaaaacattattttatagaatcccacttttagagattagggaacagaagcacagagagacccatcaaggtgacacatctcagagcaggacgaggacccaagactctctggaatggtagctcccgccatccactgtgatggccttggtcctgccggctatcgtctcctcacccccacggctgctcctttcccctgtcccagagttgtcagtagcgtcttttggtgcttgagtgccttggctaatcatgaaagactgaattggctagtgagaactgtgggagtgaaggtttatttctttttttaaattagaaaaagaagtcccctcttgtatcatctttgcttctctataaacagtctttgaaaggtacagttttgaccaaatagccctctggtgggaacttccaagaagaatattctggagcagcatctgagtatctgacaatttctcagttagtgcagctggatcatgacgttaaccggaaccaccagagctcggattcccaaaacctaatccttggggaaggttgggggaggtgtctgggacagagccgacatttgagctgatcttttgcaggcactgctgatggggcagagacctgcccttacttaagcttgctcagtgtcagggtaaatgtggggccagggtgtgagggctctgcctgccaggaagaggaagggcagattggctgaggctctgtagaggcttcgtggcaacagcagttccatctcccggttctgcattggcccatggcagcttgatttccagctgccccaggtggagctaagttactgcatgagttgagtttcctccaagggtagaaaggacacatcatgtcctccttcttcccagcattctgatttttaaggggcactaacccagcatctgagccatgtgccatgtgcaaatacacacacacaagtacatttccatgtctacttactcagttggcaggacatcaaagttcctttccagaggttagataaaggggctgcaggacaagagggcaggaaggatttaaataattgatcaagatgtgcatgtcagagccttgtcatttatttgcttgtttgtatgtttgattctgttgttttgatttttaaccacaaatcaatggtttctttgccaacgctcttgctctaagaaggtagactaatagagaagaaacttttagaaacgagtttcctgagtctattttaagtgattcttaatcttaggtgcatatagaaattacctggggaactttaaagaatattgatactggagtcacatgcctagagtttctgatttaattgtctaggttgcaaaatgtacataataatatctaaaagctctataggtgattataagtgtcaactacgtttgagaatcactggcctatctgacaccttatatttgtatgcaggcagaaggctttattaccacggcaagatattcccatctgtaatcataacaaaacctaaatagctaatctttgggtactcatgggctggccagtgtgtgaggtgttttgcctccatcagctcattgaatccttatacaatgtatacctgaattacctggaggactgttaaaacacaggtgtctggtgtccacccccagcttctgattcactgggtgtggtagccgcctctaagatggtccttcctcctgctggccatgatcttgtgtaatgtcctccccttgagtgtgaactagtcttattggcttaattataaataatagaatagggtggaagagagggaatgtcatttttgacaccaagttatagaaaatggcataatactgtgggccgggcatggtggctcacacctgtaatcccagcattttgggaggcagaggcgggtggatcttttgaggtcaggagttcgagaccagcctggccaacatggtgaaaccccgtctctactaaaaatacaaaaattagctggacatggtagtgggcgcctgtaatcccagctacgcaggaggctgaggcaggagagtcacttgaacctgggaggcagaggttacaatgagctgagatggtgccaccgcactccatcctgggcaaaagagcaagactgtgattaaaaaaaaaaaaaaagaaaaagaaaaaagtactgtggcttccatcttgggcacactctctcttgctctttgttggatcatttgccctgggataagtagctgccatgccatgaggcagccctgcagagaggcccatacagcaaagaatggaggtgtgcccacagccatgggaatgagcttggaggcagaccttgccccgattgagactttacatgagcccacagccccatctgactacttgatagcagcctcaggagagacctggagccaaagccacttagctaagtagtgttcaaatttctaacatggaaactgagataacaaatgtttgttatttttagctgctgcaatttgagataatttgtaatgcagcaatagataatccagtaaatctggggtgaggccttagaatctgcatttctaacaagtgcctaaataatgctgatgatactggtctgctgctttgaaaaccactgctttaccctaatactgagaggctatcattagtatacctttacccattacacagatggagaaacagctttagaagttttaagtacctttctgaaggtcacatacaaggtgggtggtgctgggattcaaacacaggcaatctgttccccagagttcatgcccataactcccttgctatgctgcctcttcgtctcatcatgaagtgtgtctattccttctgtgttagattatgttgattgaattgtatctaatggtgatggctgctaatgagggattttggtctggaactttattgaggattataattgaagtggctttcctccatgacacaaatgctcccccaaattaggattactactgggatagtaataatttgtctttggatatagtgtttttcaaaccttggcatgcagtagaattacttggaaggcctgttaaaatacagattgatgggacccatcttcagtgtttctgatgtagcaagtttggggtagaacctgagaatttgcatttctgacaatctcccagtcaaggctgagggaccacacttagagaaccactgcttttgtcaaagggttatgatgctcatcctatgttgagaagtgctattttggctgaatactctgagctgtttagtgcagagagaagcacaggaaaatgaagggccctaatgctcctcctggtgcatatttttaccccatgtgccttcctgctagggctagaacatatggttggaggaaccatgcagctgggctctttctgcacgtcccatgcattccaggatgagctcagattccattctaattatcgaaggcagagtgtggttgcaggcacccaacagtgctgctttgtgggaggtgttgctgtttgtgttagatcttgagaaactgaaatgggaatgttgacaagcgactgcttgggcaagtctatctatattatcagttgtacaaacagagtaaggatggggcgcagccttgacaggtggaggtatgaatgaatacaggttaagccaaggctggcctttttttttttttcaagccaaactatggaagaactgttttacattttggatgcccagcaacatttcccttgccaatggaacctgtgttttctttctttttttctccatctctgatcaactccttcattcaacctgcagctgtatggccaattcttgcctggccagaatgggccttggtgttggcatatggtggttgagccttggccatattggagagtagagctggttcgaagcctggagcaaggacaccttgccttcctttgcaccagtactgaatgtatgtaagaaccacagctggcagattaacttggggttgccgacagaaagtttgcccttttctactgtccaacacttccgggagactcacagtggatattaagctcaattgtagaactatctttaacaaatatatacccaactctacctctgtttagtagcactaaacagatagcactaaacagacccatggtcatgtggtatgagagaagaggtgctgtggtagaatctatttgcttacaatttttcattccctttttgcccttgtcatccttccctgtagacaaaatactctcttcattctacggagtttggggctattttgtgacttgctttgcctagtggcctatttgccatacaagcttttacagatattacaagtttctatcattctcttattctgattctccatgataagatgagcatgttccaacccgatagacattgctcctcagcctggtcatatagtgatcagacctgcaattcacccacaacttgaagtagtgtcttagagccacagttgacctgtagctgatgtgtaatgtgcgtgacaaataaatatgtgttttgtaagctaagatttgggagttgtttatcacacagaagaagctgcaaaaagctgactaacacagagctagagccaaatcctcatgtagattgcctgatttctcaaggaggaggtgtttgacatacagagccgagctttgtttcacaaattcagaaactcttactagagtggccacttggaaatgttgcctaaatattaaaagcaaaatttgtatatcttcaagagaaaatacagaacatctgtatgagccagcagtagaaaatatttttgtgaataaaacataaaagattgataagttgagtaaaatgaaataagatttttgtacaacaaaggactcataagcaaaaagaaaagaaacctcagaggtgaagatatatatgcacacaatggttgtgtagtaaaatcagaatatgtaatgaattcctacaaatcagtaagaagacaaggaaagcaataggaaaaatggcaaggctattgtcaaaaattcatagaagaggtaacaagaatggccaaaaccaggtagactatcctagtaattagagaaacatgaattaaacaatgagccattctttaacaaacatcagacttgcaaaatttagaaactctgccaatatgaagactatgttggtgaaaatatactctgtgtctgtgctaagaatggctgagacacaaatcttgttcttgggggacttagcatctaatggagaaagcagacatgtgaagaggtaattgtaaaaccttacgattaggcattgtagtgatgaggcatgctcagggtagagtaggatctgaggagggatcctgactcactaagcccatgggagacaaggaagacctcacagagaaagtgacatgaaagggaaaaagagaattccagacagagggagatggagggattgaaagagaatgggtctgattagggaaaatggcatagaattgaaaaatgtgcaatagaagaattgacacagaataattgattccatattgtgaagaaatgagtcagtgatatagaggaaaggctggcaaaactctttcataatatgggggcaaaagacaaagagataaacatttgcagagagaagatcgtgactgtggaggaaatacagtattcatataactgatattgctgaaataatggaaatgataatcaaatggcttgatttagccattctaaaacacatacatatattaaaacatcatgttgtataccataaatagatgtaatttttacctgtcaactaaaaataaattttaaaaggatataatggaagaaaatttgaggaggcgaagaaatattgaagaagttccatttggcaaatactagaaataaaaaaaaaagggaaaacaactaaaatctagacatatgctgctctttcaaaaaaatttcaaggacctttttttcctaattagtaatgttgtttttatctttttaattataaaattaatgtatatttattttcaaaaattagagaaatacacaataaaaaattacatgacatgataatattactaccaagaggtgccattactattatttatgttctttagtgattctctttgctatttatacaaaacagcgattgtattgtgtgcatgtatatacttttatgcgtacatatatgtatacatgtaggtatatacatgtacatgtgtatacacacaagcatgtgtgcatatgtatatatatatttgtacaaataatttatttcttttttaactgaatttttagatgtatatagaaagaaggatcaatggaacagcatagaaaacataggtagttgaagtctcaacatttttagttatttttgcaagttttgttattttcattatgatgattttcaaaatattctgaatttgcagttttgattttttttactcaacctaattattactttggagaggttttgtatattatatattctcctgaaagattttacattttgcctttcatatttaggtcacatttccaagtggctgttttcttggttcatattctagaaacaaatccctggtttttctctgctgtggtcagagaataggcctgaagagacttttcctctttggaacattttgaggttttcatcagggcctaattatgtaatcatatttttgtaaatattctagggctctggaaaagaagactgttttttttttggtttgtttttaaagtaaagcatcttcactaacacttggttttggcagacttttctaatttgtgtaaatctgatagttgtaaaacaatatttcgttgtggtttatttcacatttctctaatggcttgaggaattgatcatcttttcatattttttagccattcttgctttcttgtccttgattttctgattatagcctttgcctttttcttattggtttatcttttattgattattttataaggatttattatattttctaatatatgagttagaagtaacttctacatgtctgtagcttctcttttcttttgcttatgttgtcctttgtcatgcaaaagacttttaatttaatttgtgtcaatttttgttttcgtgttttgtgcttttaatattttgcttaagaaaatcttcccctatgttagattatgaggatattttcctctatgtttctcttgaaggatttataattttgcttctcacaatcaagttttaaactcatatggaatttctccatatatatagtgagaggtaggcagtctatttatttattttttcactttatatggccagttgctacaacattattaaataaattctttcttctctaagtttttattgccaccatatatttgtagacctgtcttggagctttttacttagtgctgcaggtaaatttatctttgcctatactgatgccacactgttttagttactgtggcttcctaataatttcagacaaatagtagggcagatcacccatccttattcttcaaaattgttttgactaattttggccctttactcttccacatgaattttaacatcagcttatcaattgccatggaataccctgttatgatattcaatggaaacatgtatttatatatgaatttagaagctcttgctttatttatgatactgagttttttaaaccagtggcatggtgtatctatctctgtatttagaattatgttcttacatatagttttataactatcttgataaattcctgcctgtttgcatttcctttttgcatttattcttagatattttacactttgtgctgttcttaacaatgagatttataaattttattatagtttacagtttttataggaataatattgaatttaatatactgctcttatattcaaaaataatggtaaatattttttagtagttctagcaactttctatattgtcttttattttcagtattgtctatgggactaacagtgatgattttttctttctaatccttcatacctcttcttgcttgcccgcattgactaggacctatatgatgcagaataggtgcaatgataacagcattccctattctttgtcctgactttaaagagaatgctgctaaactcttaccatttcacataatgtgtgctggaccttttagctaaatatgctgtatatattgtatcaggaagttctcactactttccccagtttgctaagaccattttttttcaaaatcaagaaaggttattaaattttatcaaatgcttttattggcatcttttgagatgctcatatgctcgtataatttctctcctttaatatgttaataaggtgaatttcattaatagattttttttaacatttaattatgctgggatccctggcatatttccgacttgatcattatgtgtttgtgtgtgtgtgtgtgtgtgtgtgtgtgtatacacatatatattttacaaaattatatataatacatatatattaaaaatacatatatatacatgaatccgtatactatatctccagaatttattcattctgtaaaattgaaactttgtacctttgaccaatatctccccatttccctcaccccctaaattttatacatatattatatataacatatataatacatatatacacacatacacatatataaacacatgtacatatacatacattgttgcattcagtttgctaatattttaattaagaggctattgtaaaatttgctgtctatatttttaaaacctagaggtaaacttggagggaattatgctaagtgaaataagccaggcagaagaagacaaatactgcacaatctcacttatatgtggaatacaacaaagttgaactcatagaagcagggagtagaatgatggttgctagtggctgggggttgggggtggagaaaattgggagatattggtcaaagagtacaaagttacaattttgcaggatgaataatttcaggagatctattgtacagtatggtgactacagttaataaaaatttattgtatacttgaaaattgctgagagtagaccttaaatattcttaccacaaaaataataaatacgtaaagtggtaaaaatgttaatcatctttattcaatcatttcacagtgtatgcacctatcaaaaatcatgttgtacaccctaaatatatacaattttaatttgtcaattataccttaataaagctgagaaaaattaaaaacattctagaagtatttttcaaatttgcctcctctatttttcattaccattttctttaatcatttttaaaatctcttccataaatcaaggtattacttcttaattttcctatttgttatgcctggtgactctccatagttgtggttcattttcttatttggtttgtaatttctgattctgaactcatcttcagcagtgattgattgctctggtagaatccagtagttctgtctagcagaatcttcttttgtgaatcttcatgctaatacctgggatttttctggttccccttcaaagcctaaacagttctttgaggatttcatgtttatatacatttctaattcgacccttgctttatacagaccttgggttgtatattcctatccttctgtggacagtgaaacccctgccatctgttcctgactctgaaagcatcctgaaccattgcagtgtcagctcatacatttcctgcctttatcttagcatcttgagatatatttttctttctttcaagagcttctatgaatttttacataaaaatttatatcttggattttactcaggatttctgtcagtttgttatgggagggagtacttttttcagaactcctggtatgtcatttttctagaaattcaaaatctcttcattttatttttaacttttataattatattatctctgcaatttttcttgatcttaaattacctttgtgtctgactgcagtagttttagtagtttgattcttttccctaatacttttttgcccttttacttatttaatctgattcttctgaatgcccattttttttttaattgaagtatctctttttagattcagggtcttttgactcttgacaaaacataaaaccctttagagcagtgcttctcaacctgctgtctagaggctaccagcattagaaccatcttgattctttcttagaattgaaaattccctggcgttcctctcattcaagatgatcaaaatcatggaggcaggatcctagaatctatatttcaaacaaagattctatacacttggagaattgctattaaatgaaaagatcaatcttatccagtatcagttcatagttaaataaggtttaagttttcttatttgtgtttctacatgtttttacacagtcctctagcccgaaagtaggaagacaaatgtccaggttttctctgaattccagttcccaacttggacatccagaagcctctggtgagtcaggaaggagctaaggctagaaaccctggtggatctggtggtggcacagaggaggccttcatcagtgggacatccaacatcttctccacatttgacatggtgtccagaattgtcccattcttttttttttttttctgagatggagtcttgctctgttgcccaggcttcagtagagtggcacaatctcagctcactgcaacctctgcctcccgggttcaaatgattgctgggcctcagcctcctgagtagctgggattacaggagtacaccaccatgctcggctaatttttgtatttttagtaatgatggagttttgctatgttggccagtctggtcttgaaattctgacttcaagtgattctcccaccttggcctcccaaaacgctagattacaggcatgagtgagccaccgtacctggcccaggagtgtcccattctcaggccttacatactagtaggtcctttatctgcccttggtggctgatgaagctggaagatgtagaggaccaccaagagccatggtggaaacaagatgctattgacctccagtggtgagatggaccccacataggctggccccattgccctcagattgacttatcagcagctcaaccctatgagtcaatttctgctgggggccttcttctctctctctagacaggctatcctttaaaagaggaagtcaggcttgtgccatccttctttcccctcccatctgaatattttggggggctggtcaagattttggtccctgtgtatggtcttttgggcattttagtgggactctgagaaggcagaggctttatcagtttcctttatgtatattaatgagtttcttggaatattttcacagcatgggtgtgaggatgagctacaagaattttcaatgtgaagttgagtgattttgcagttgagtcggacaacaactctgaaggttgctcttatttccccatatttatggcctctcaagtattagtaaatctaaagtatgtgatccaataatttagcaaagtttaacttgatgggttcaataatttaaaaattttaaagaagcaatgggttagtaaatttgtagttattttctaggtaaaatagtaaatgatattattttaagattaaataaaattttcacattgtttcatttatactgaaaaaaaggatagtagaatttcaaaagactgaaaaaatttatctataggtgggttgaaaaataaatattacagctatttaatttcccaatttctttttttgtgtgtgtatttttacttcttttctcatggcatcaacatttctgagccttttgctgctagttgtctaaaagccatttggcctttcagctcaaatcacaaaccccaatctctaacttccttgaggttgcaacttgagcacctgaaaatgtggccagcttcaagccagagtgaaaatgtttttttctttcatcccttttgacagcatcccaactaacaccactgcaagagggaaatgtcaaattgaggtgaacacccagctcaggtctgatctctgagccatactgcctcgtttgaatagggaaactaggaaaggaggggtgataactcagccatttctaaaaaaggaaaatgataacaacctttggagggccagccatagaaaacagccctgtgagtgcatgtcaaagcagccaatctgcttctgcttaggcagatgtcatgggcctggatcaaaggaaggcctgctccgtgccatgtgctcctatgaaagagaaagtgggtggaaactggaggcttttgttggtctttggtgttttcttaacaagagaacagcctcctagagaaacagcgaaagagccaggtttctgcaggagaggatcccacggagcagcgttggctgaggtcccttcagtgtggcaagatgctgctctctctggtggagggatttgggttcacttcctcgacggaggtggttccctgaggccacccaacattcaccaggctcactgccccatccttgctcttccatgctgcctctgtgctcctggtcaggatgtttgtcagtgcttgagaagggaattaccatgcccattttagaatggaagaaaattaggttcaatagagtgccctagggcacaaagcttatatacccgagtctggattaaaatttaggcctgcctgatgctaaatagcatgatgttgggcaatccactcactgtctctggttcttacttttctctctgacatgggtgattgttaaggtcagatggcattcattcattcaacaaacattgtgtgctaactctgtgccagaaactcttccaggtgctacagatgtagcaacaaacatccctgccttcacggaacttcccatttggtaagggaacacagacagtaaacaaagataatgtcatatgcagtatttcagagagtgtcaggtgctacatgggaggcgggtagggatggaggggtaaagaacgctggtgggaggtataagatttttagctggggacttcaggggaagcctcatggataaagtgacatttgagtaaggagatgggagactgagctacatggataattaggggacaatattacaggacgagtgagtatgtgccaagtctctgatgcaggagtgaatgtggcacatgcaaggaaaaacaagaagtcactgtggctggagtggatcgaaggagagggtgtcttggtcctttcgcgctgttttaacaaaatactgtaaggtgccagcagatccagtatccgctttctggttcagagacagcacctccttgctataatatccttatgtagcagaaggggcaaagcagctctatgtggtcccttttttataagggcacttatttcagttattaggactcttcctttatgacctaatcatctcccaacagtcccatcttctaacagcatcacgttgggggtaaagatttcaacttaggtatttttggagacacaaatattcagaccatagcagagggaaagtagaacaggatgccatagaggtaatgttgtggtgcatgggagggggaaggttgtcacacacagcaatctgtaggcctttataagagatgatgtatataaaaacatttttgatggtcaaagggctgtctaaatatatatgcaataatgtatacatatctgttttgggatttgggttctagactcagtctgcatagtaggttttagtgtctcactctcagttctgaaattctggctcttggaaagtcattgttctcaaatgggatgccatgatttgtaggtgtaatctatcccattgcaggcattaaattcttgataaacacataacatacgttcttttctgaaattgaatttgtggctactatggctgtgcatggatttttaagttgactggggttattatggggtgcaatgtcttaagattataaaagctgagttgtagcttaatgccaagccaatatcaagtaaagacctaattctcctgaaatgcataagaaggtcacctagtgaggatggaagtgaggaagatcagaatggtgaactgacaactccatcagcatcccagcaataaagggagagaaaatgtattattcagtaactgtggatgcttttatagacactgcaagacattgttattatatagtagtgcttgtgctttcattatggttgacctgttacaatctgttattcggatattttaattctgctaagcatgaacttcaaatattcaaaaacgtgtggcaaagatatacaagtaaaaaagaaggttgagaatgaatattttagaacttagagactgtacgtgctgtgttactgttgggtggatcacttttggctaattatgaaatttagatacactgattagtcaggtttgactcttgcattaaataaattattttgctttgacattgggtacttggtttacaaagtactctacctttcatcatcagattttatcctcacaaaactcttgtggaggaggtagtatggaattgtcaccttcatactacaaatgagaaaatagggaaatggcatggttttcccagtcacactagtatatagtggcagcaaagatggaatgtgagttcaaaggatcaacaaactcataggttctttctgtcctagactgacttgtgaataatagcacaatagaggaagacagttgggtcaaattagttatatgttgtgtgtagaaaaacagccttccaataatggcacttcccatgttaattattttgcatggtgtgtaaaaagagcttgacacctatgtaggaggttcaaagcagctcccaaactatattgtcttcatgcagcccagctaccgactgagtatggctagattgtcagtacactgctaacttctgtgttctctcctgtaatagcagactggactctgcaggcctgatcaagtaggaatgggtgggttgaaagtcgtgatcattataaatcaattatctgcagtttgctcaagtaagggtccttgtcattatgcattatagcttaattttcccaactaaattgacctttcagtggcccatgcccattattgtttattttagaaaacttctaccattgcccattctttagagcagagctgcccaatagaactttatagaatgatggatatattctgtatctgcactgtctcctatagtagccactagacatgcacagctattgagtgattgaaatgtggctggtgcaactaaagaactgatttgttaatttattgggaattttaattaatttaaatatatatagccatgtgtggctggtatcgactacatggacagtgcagctctaggaatgctgtgattcccatgtctcattctcacagctgctgggtggcactggcagttgacagccctcaagagagtcctctggaaatttctgtcagccaaagaaagccccttggcccagggtcacacttctttctgggacagcccacattcagtgactggtctgggcaggatataatggtctggccccctcatcccaatttggaacagctctgaagggatattctaacttcagaactccttatgggactggcaaggcttctattgcaactgtatcccagttctgtttctcccctgccttgtgttcttcctgcacccctcacagatgttgaccccaagagcatgccccagtaactggctgcatgtgaatgtctgtctcagagttggcttcttgggagcctgatttatgacactgtccctggcctcccacccaattctgcacatctcagatataaactgttaaaacaagaaagcaaatgcattgttaattttttcataacttgcattttacatcagcctgggcccatatcacaccgggaaaaggaaataaagtcatctgaataaaggatacatttctgcaagaagttctctgtccaaggagtcagtagaaggaaacactatgaatgacactgtattctaaattttgtcactgtcactttctcttccccccacaaggtcattttcttaattcaacaaacactgactgtgcatgcacctcctatattctagaccaacattagggttctaggtgcacagagatgacaaatgcagtatggttcttgttctcagtggctcattgtgtgggtgcagaaggagatgttcaggaggcattagataatccagtgccaaaagtgccacatttaaggtaccagggtacactgaagatatgcaggaggaggagggactcttctgtggggatcaggaaactgtgactctcagactagttttgtatgggtcatgagttaaaaatgttttccaaattttatattgttgaaaaatactcaaaagtagaatcatatttcatgatacatggaaatcacatgaaattcaaatttcagtgtctatacagaaaatcttattggaccacagccatgctcattagtttacatatcatctatggctgctttcacacaccaccaccagggttgagtagttgcagcagaaagtgtataccacctgtaaggcagaaagtaagatatttactctctggccctctacaggaagtttgccgactcttgggttagtgcaatcaaggaggtctatctgtaaagagttgcctctgaactgggttttaaagcatgaaagggaattttccaggcagaaaaggaccagatgaaggtaactctggtagaagaaacagcatgtgcggaggcatacaggcaagaggcaggaggcaagaaaggaatagtatgcataaataataagtatttcaggctgggagaggtggcttacaccggtaatctcagagatttgggaggccaagataggaaggtcacttgaagctaggagttagagaccagactgggcaacaaagtgagaccccatcgataaaataaataaataaataaattagctgtttgggaggctgaagttagaggatcacttgagcccaggagttcaaggttgtagtaagctgtgaatgcaccactacattccagcttgggcagcagagggaaaccctatctcttacaaaaaaaaaaaaaaaatgttggtgcatttgggacattttgtttggagtgaggtaggaagcaagtatgaaaaactggattttcatgctaaggaatttattcttcatttcttaaacagtgaggagtcattgaagtgttttaagcagaggagtagtttggccagtttggggtttcaaggagatcattctggtggcccttacggaggaagctttggaggaggcgagaccaacgcagggagtatttcaacaatgaagacaccaagagcttgacgtggagtagcagcggtggggattccagttcctatgtgagctcaagaacccagagtgtaggaagttcattttgacagactggtgggatgaagccaggacatggggcgggaaaaggttaggaaaggaaagagtgaatcagaggcgggggttctgtgggtggacaggcagctggacaggcagcagcagaagcgatgtaggacgcagcttgggggacagctgaagggctttggggttacagcagcggaagtgacttgagcagaggagggactctggacatcatggacaatggggcactgggaagtgaggagctggcggcagggtgggcacaggatgatgacgatgataacagtaatgatgataatagcaataataacagtggaaggtcaaaggcagcttcctctgagatggccagatgagggagggggctagtgtccagctcactttcataaggtcgggctgtaagtggtgaaaagcaagctttgtgtggtagaaacagaggccagctgctgccagaggggaaaggaaggtggaggctgaggtgggatattttccaaacccaagaaccaaagtaaataggaaatggaatctttaatgctatttgagctcaaacaaaagatcaccacagctacttcagttgagttccagtgatccctttcacttggccaggaattagcgagaggcctccccagctgtgcatctctcctctaagccttcacctgagaatgagctgaggtttgaatgaggcctttatcctgagagttcagggggctgttctggctccctgatcaaattcaaacctctgttttgggagacagacatgggaaaaatatttacccctttcatgttgacacatggatatacagggcaattctgtcagaatctacacgaagccagagctgcattttaagccagtatcaggggccactgtttttggggttgcttaggtgaccgtgtttggggtcagttgcctgatatagagggagtgctaaacaggggcttgtacagaagatgacttggggagtttgagtccacttacccttctctacactgtgagaagcaataacattcttgttaaccagtagtatataacattatctcacttaatccttccagcaacagctctcttaagttaaaactaatattagccttattgtacggatggagaaactgataccaagaggaggctagaatagttgtgcaagtcagagtcagtgggaaaaccagattcaagctgagcaacaaaacagaagagactctgatcttgtatatcactggaggattgaggaattggaggagcatcttccagggaacgtctctgttgactgtggaccagaatgctcttcatctgtcctcctggctatctccttctcaactgtcatgtgtcctccccagggtggccttctctgatcactcaagccaaaggatatctcagcatcctgtacggttttttcaaggtactggatataattgtatttatttattaccatgccccctcatttattttgcttgttttcttcagtagaatataagctttgtgtagtccagggctgcgtctgtattgctcactcttaaatcctggtaccaactaaagtgcttggtgcacagtatgaatgatgcatattctgttgaatgaatgaccatttcagctccccaggaatggggcctggccaggaggctgggtttccttgggagcccgaggtggatagtgtccctttggtaggctagtttgaaaggcagcagggtagaaaatgacagctcaacttgtgaaagtaaagaagaaaatgtctcacttttccatttattttctgtatttcaatatggaagagtataactggagatgggtgatgcagttgtaagagaaatgaaccggtacctgttgtagtgttgaaaaacagaattagatgcggaggtgaatatttgttgtgtattagcagctgtgatggctatcggctttacagacttgatctaatttttccctcacaatgatgctgtaatgtaatgctctaatgctttttgcaagcttttccattttacaggtgataaaatagaggctcaaaaagggtaaatcagccaccatctgttcaacattcagacagatggtgaagatgagattctaatgcagttgtgtcaaacttcataactcttttcattagtgatatgagtgcaagaacttgagacagactgcctgggttcatattcctggtctgtcaattactggggtgtgtgattttaggaaaatttcttaccattttgtgccttagtttcctcatctaaaaaattaggataatactggtgcctatcttataaggttgtagggggactaaataggtcaatactgttcaagtaaaaaatctaaaacaatacctggcgctattgtatattattttatcatcatcatcatcatcatcatcatcatcatcaattatcttcctcctcctcatcatcattttattggactaaatactctgcttttggcttcctactttatgattaattttgtatgtcaatttgactgggtaaagtgatggctagatagccagtaagacattatttctgtgtgtttctataagggtgtttctagaagagatcggcatttgaattagtagactgagtaacaaagtttactcgcatcatgctggtgcgccccattcaatccattgagggcctgaataggacaagaaggcagaggaaaggcaaaatagttctctgcttgaactgggacgtcatcttttcttattactagacattagtgtttctagttcttggggctttggacttggacttagattattggcttccctggttctcaggccatcacatttggaatgaaactctatcgctggattccttgggccttcagcttatagatagcagatagtgggacttctcagcttccataatcatgtgagccaatccctaatccctcgtgagaaatatcttcctatatatttctatttatcctattaattctgtttttctgaagaacgctgactaatatactccttctaagctgaggttgtgcagaggctgtaactaggaaggggaaccatctaggaagatttgagtgaaagttccagttcatgggggccctggaagcagcaagaaatagatcatatctggttcttatgaaaattatctttttcctctgctgcttctttcagaggctaagaggttccatttcaggtttcctgagtttctgcacagtgattgtgacctttctttcctttcatctttcacttctggtagaaagggagagtaacgagatgaagactttattaggaaatgaacacagcaaagtaacactacttggccatttgagatagcacattggcaagagtgtcagggatgctgctaaggatggtgcaaggccaggctggactcagaccctgagctcagacacaggagtctcagggtgatcttttagaagctccagggtccctctaggggtagtagagaagacagaaggagctatgtgacggagggaattcctaggcatgtatctgaaaggtgtctttgaaaaagtaataatttgtaccaactgagagcatcatggatgttccatgactatcaacacaggaatgtttttctattaatggactggactggtatgttttccatttggaggataacccaggggttccacagtgagctaatcattcttgagaggttgggatatatttctttgattttgccccaaagaagaggatgtttttaggagtcttgagagcccgtgcatctatcactgcaagctcttttcgttctaggatgctcagttctctctttaacttgacccccattggggctgcccccccatatcagaaatgtagacagagctaggtccctactaggctgtaagtaccatgaccaaaggagccatggctctagatctggccaaagatgatttgggaagtgtaattatctcttggctttctcagctaacttcggactctgtgcttctctaagctcaggatgtcctaaacccatcttctctggagaaatcaggtagacaagagatgagaggactctggtctccctacaagtttccttggcctctcccagaaccctcaaaaacccagaatgtgagttccagtgtaatccatcagtgcagaaaagaatgtgtgtggtttgtttaagaagaagcacaccctatgtggaaacacacatctgctgggtttttggtgggatgtgctctgctcagcctagagagtcaggcagtggagaatgtgtctgcccataggtggcagtacccaggtgagttctacagaaactagaatgcaatgaggtcctaaacttacagcaaatcaataaaaatcctaagtaggccctgatctatctatgaaaatatctccctcccctaatttccactctttcacctaactggggacaagggaagtaaaaactccttaggaaaatgggagaaattttggcactatattctagtataaatggttaattttctgaagttcaaaaaattggttaaaggtcataaaagaagaagaggattcatttgcttgtttaataacttactaaacaacatctttggcaagaacttatgctcagttaagggaaataacaacagagtctcaatgctagctttgagtttggagtttgctctgaaagataatacttcctgttgcctctttattgttatatcacaagtgtataacaaagtggttgaacttgattaggatgtttatatagctgattacaaaaaaaaggaaatggacatttattgagtgtttactatgtgcccaacactttctcatctaataaatattgtagtgtaatgctggtcacactcaaacactcagtggattgtagctgtcaatccactgattattggattgacagtaattgataaattactggattgacaatccactgatcattggatggacaactacaagccaaaaaatgcctggagccaccagaagctggaagaggtgatgagttttctcccaaaagccgttagaaggagcatggttctgcagaccccttgatttcaaacttctgacttccagactagtgaggaaataaatttttgttgttttaagccaccaattttatagtagttttttgtggcaggcctagaaaagtagtacaaccacctaatataagtatgaccttaaacttatcctccctcagcttggattccctgtatcagaaaattggaaaaatactaagggttgttgtaaaggttccacaagaaacacattggaattattgctcatagaatgggaactggagataaaggagattaattaaacaattattgtctttgcctgaaccagtgacaataccatgctaggaactatatctaaggttcaaagactgtgtgggatccaaattttgccacttaatgtctgtgatcctgggaatcttaggtgggtgtaagtaaactgtgacagaatttatctatgaggataaaaatggtgctggcttattgagtggttgtgagctttgaatagataatgcaaacacaatcagtccttctctcgtgtttattttgaaaatgggatttgttccaaagtaattgatatattagagaataatctgagcataatgtgaattctgtgtctgcttatattgaatttcatccacaagaaacactaggtgaatacagaaaattataacccaatgaactgagctgtgtaggaatacagaaaacacacgttgatatggtttggctccgtgtccccacccaaatctcatgtagaattgtaatcctcagtgttggaggggaggggtcgggtgagaggtgtggatcatggaggcagacttcctccttgctgttctcataatagtgagtgagttctcacgagatctggttaacaatgccctttgtgctctctctcctccaccatgtaaagaggtacctacttctccttctccttctaccatgattgtaagtttcctgaggcctccccagccatgcttcctggagagcctatggaactgtgagccaattaaacttattttgtttataaattacccagtctcaggtagttctttatagcaatgcgaaaatggactaatatgcacatgtacacatctcaaacatctaccatctcctcagccacatgtgttaagagtcacattcatccactcttagtgttacaaccttccatctgatttcagacgactctccttcataacaactgacaagctgcaacccaatgcccaggaaacttatttcgcaagtaatcctcagatctatttaaaggtaaagtgccatatttatggtgatatttatgtatgtctgaccctggaagcactgactggaatccctgcttccatctccacatgaccttcttccttggctctctgtgtctcaaatctctctcttctctctcttttaaaatgacctcatctccagatttataacttagttacatttgcagagactctatttccaaataaggtcgcattcactggtaccagggtttgtatacaggacacatatttttgggggggacgtccttcaacccagtacagtggtatgatggccagttgtaccttggtcctttgaaaagaagcacattgctatttctgctagaccataaagccacccagcatttgaagtgcagagacatatactccattccctacagatacagtaagattttaaaatactgaagctgataagctctatctttggcagaacttagttttgcatccttctgccaattgccttcccccactcttgggggatatctatagaggatcacttcagtatctaagtggaaagctttatgggaagaggatctataggttcttctaggtgctaggaagagctttgtgttgcaggtgagcacacctggggcctgtagatgtgcttgggggatagaattcaagtctttctgaagcagaccttccttctggactcagggatgaaactcttgcagcctctagtcaggacaccaaattacctagatcagtgcttctctgactttaatgtatgaaagaataacctggaatatttgttaaaatacagaatcctggactttacctgcagagattctcctttagtaggtctgagctgggcccaagattttgcatttctaacaaagttttaggtgatgcttttgccactgattaggagaaccactatctgagcaacactgatctaggcggattgtacaaaaagccatgtgggtcagtctttgtatgtatcatagtgaaaaatggtacaaaaagagcagttcaaagtatttaaaagtaattcttatttggactcttgcttcttaagaaacattaaaaaggattgaatttataagctagagcaatagctctcaaaaacttttctgtgctttcccaattctttcacccctatggcagaacagatttttttaattcaaatcctgaactcttcctcattaagctctggactttcctctttttctgcctcttgagtcctctgactctgattctcaaaattctagaatctaagttgttaaagaaaaaattctcccagaggcagaagtgaagggtggagctggcaaggcagataacactcccaagttgataaatcttgtatctcccaaagttattaatatttcacatctaaactccaaagggaaacctcactgatccaaagtgacctgcaaccactcaagataatgtttcttttttaaataatttaactttttgtgacagaaaagcaagggcaagtgtgtctttagtagctccattaacctataattttccctataatgccactgagattggaagtgttgttactttaaaaaaaagtctacttgagacaaacttgttgattatattatcagaatttctttatacaggctgatttttggtcttctgcagaaagtggtatgttaaatttttccttataattgtgttttcatcaaatcctttgtacatttagaactatttgccttatgtaacatgctgctatgttgtttgcagcataaacattttgggttgctaaaaagatggatttatatttacccattttcatctgtcacttatgtgagggattagtctataaatattatttttaaagcaatagaactcttttctcaaagtgaatctaaagcaaaaccccaatatataaaacattagctgcttagacctagaggagatgggtctggtccagcagttttcaaccaggctctgcaaataaataaataaataaataaaccccatggatcacaatttgagtaaatattttccaggctatccttaggatagtacatagaaaatgggttagggctgtagggcttccctagaacctgggttgagagggttgtgaggtctgtggcctggtagagaggcactttcaacaaattagcgttattgtgcttccttcagacaatgcttcccccaaaatgcatatggttaattgggattatgcactctgatagtgattgaaaaaatctctccatccagtctatggttagtgatgatcccagatacaggtgaaagaggacaggagcccagctacaggaaaagtcatcaggtcaaggaaattcatgatgtatgcacagagtaattattaagatatttttctgatatttcatatctctttccttctccttttttctacctccaccgcctcctttggtgggacttactagagtatggagtgagaattagagatgaaatgtgtccctctcgcagaatccgcagaatctgcttagctggaagttagcccctggagggcagcaacttgtctgacctgctctcggctacatccctagcacctaggatcgttccttggtgggtgcatgagtgggtgactgactagtgggtgactagtccttgacagagtgggtgtcatggactaattggagagacagatatgaacaaatacttttgaaatgatatgatacatgatgacatagatataccctgactcctaatgaagcacaagagaaggatggatgaaacctatgtgtggaaattagaccagggaaagtatcacgaaggacagatgttattacctaggactctttccccatctctgagttggccatgcacaggggtaaatgggacagctggatgctgcaactggtggaggaaggctaacacagagttgcatggtgttattaaatgtcccagtttccagtctgagagtcaggattagtctcatttaagaaacatgatctggccggatgctgcagtggctcacacctgtaatcccagcaatttgggagggcgaggtgggtggatcacttgaggccaggagttcaagaccaggctggccaacatgatgaaaccccatctccactaaaaataagaaaattagccaggtgtggtggcacacacctgtaatcccagttactctggaggctgaggtagaagaatcgcttgaaccctgggaggtggaggttgcagtgagctgagatcacaccactgcactccagcctgagtgacagagtgagaccctgtctcaaaaaaaaaaattatccttgtgacacaggtatgatacttcctttgttattggttgagtaatcgatagagttgaatagtatgttcattttaggtcactggggtctggcaggcaataagtggtctaatgggttgctggctcctttttgctgatccactaaggcagtgttgttacaggatttttcaatgaaaaaaagaatccaatgggaggaaggtcactgaagctatacctgctttgtttcatgggacaaatattatgccttgccttacccaggaattctaatatgcactcctatcttgtggatcacatctaaaagtagaagtcactgtattttttttccttatgaaccatcttcaagaagatttagttgagctttacctctgaaaagaatcaacatttttcaattcccaaatataaaatttcatttgaaacttccatgtgcttttttgaatgtaccccacccctgaaaacctgctcgagaggccagtgcacccctctagatagggattattgggtgagatgatggaaataaaaaacgaaaatgggttctttttctcagatagctactgtcttactcaaaaggagattaaaagtaaattaagaaaaaataaaagtaacttcaagtataaaaccattaagaacaatgcttaaaggaattgcaggaacaaaatcaaacaaagcaaaacagaaatgcctacaaaaaagagctgtaaatattagtctcaaggaaaaaataagagcaaaagttatatatattctctgtatatatatatgtatatgtatagtatatatatatgtatatgtatatgtatagtatatgtatatatttctatagactaatatattacacatatatacatatatagactatatgtatacacacaaatacaatatacacacatacacatgtacacacactaaggtctactaaaacacacacaaggcttcctatgcacctgtctgtgtctccctgcccaaggactttacctggccccttcagcagtgtgaggttactgaagttcactctccaggagctctataaccagtgatggacaagagtttctggaaaaatatccagcttcccatctctccatgggagaactctagggtatgttcagcattttttagtgggccccagtgggatccagctccaagtgctcacagggatagcaggtatattataccacccttttgctggctttcttcacttccacactttttcactctgctgctctggatccagaataatcatttctcacctaaatcctcaggggctgcttttgggagaattcagactaaggcagtacaccatagacacacctttcaagtttgtcaaaaatttattcaggtattttaaaaaaatgatgcagttcaaagagatacttctatttctttatctagatatatccttcttatttatattaatgttattagatttatctacatctctattcagtgctattgaaataaaataattgaaaataatttctatgctaaattcccatttgtaattatttataactttcaagagactttgagtccaatagatttttagtcactttatgtaaaatctcacttttttttcttttaaattttatttggcagaagacttggcctgtcccatatggtgagtgcatgtgaagtcccttggtggaaagtgattctttatatttgttttcctgaaaatttattgtcagaacattgttttggaatatgtgtaattcctctagggggttaaatgtgggtggtgagctgtgtagagaaatattacttatgacccatcctgggcagtgatattctcttacatatttagtctggctttgagtacctagttgatgttaaacaaatgctaattaataataacctaatagaaaatggatttagggcaaacaaatgcaatgcctaatgacatcctagatttttcaaacaacattcatcacatttattttagtcttctcaaactgaagccattatttcaagtcagttctgcagaaaagaggaggttaggtttgagtgtgttttttttttttcccagaatattccattctgtaggtgcctgtaattcctgggctgagatgaggtagctgtgtgcagtggggatgtataggatgagctgtaagtttcctctataagcctgaggttctttcttctccaaagaggacactcactgaaatttagtgcatcatccaggaaactgtgttattccaaaagaagataaaagttttatttaattaatagcatggctgaaaccacagactcccccatttataacctggattggcgccaagatcaggatcaataagaatgcaaatgtggtgttaacaccttcttcctctcaagaactgttttatccctcacttatccccattcttccatagagaccatctagagttagttattcatgttctggacccacacgctttccaacttttcttcctcattctggacctgccatatctttcagccacggttcgtccaagatgaacaaataaacacgtgatgaaatattattccaccttaaaagtgaagggagtcctactgtatgtaggatgaacatggataaacctggaggacattaatctaagtgaataagctagtcacagaatgacaagtattacgtgattccacttacatgaggtatacaaaatagtcagacacacagagagtaaatagtggttgccaaaacctggagggagggggaaatcggggagttgctattcaatcagctttaagttatagttttgaaagatacttctagagattttcctgtacaacactatgtttataattaacattgcattgtacacttaaaattttaagcagatctcatgttaagtgttcttacacaataaaaaataagaataattaagaagacatatttaggtttccatttctaccacgttcttctctgagcttcagtttacttctctggaagtagtgataataccaacctagtgtcattatgagaactaaatgtgataatgtttattggatgtctggcacgtcagtgacagaaaatggatgccagttttatgcccattagagaggtgtgcaaggcttagtgtaagcaaaggctctagagctgaattctgcctttgttacttgtgtggttttgaggaagtcttttaatctcttgctctttgactcagtttccccatcagttaaataggggcaataatattatctaaaatagagggttattttgagaattaaataaggcagtgtgtgtaaagtgttctatggatgtttgccatattattattattcgtttcctagggaaatgagtagtccttcttcattatctcttaatacagttctattattctgtgattctcccttcctatgtaggaaaaatgggttctcattgctaaaacttactaaggaaaatgctgatctcccaaaatagctattgagcagtaattttcaaaatacatagtaaacccaagctatacatgaaaggctcttaaactaggtcattgccgcgggctgcttagagagggtgccactggggtgatttatgtctggggggattattaattaaacaagagggtctgtgtttttgaaaaatgcctctgccacagaagaactgtgcctgaagagacataaaggaagagatgtgattagagtgtatctgtatctctctctatctctatatatattcaaaagattatgcattaaacatatttttttttccctgcatttaatgctttcaaagttttcatacatctctgtcctgagtttggactgctttggcaaactcgctgccttaaaggaaatgatatgtgcacatgaaattgctgtgtcaataagagatcggttcttgtttctgaggaacagatgaagatattggtgtgtgcgatatgtgtgtgccagttctagcagtgtttgtttaaaggcatatgaccacctggtatttttctgtatcagatttatttggagaaacttttttttttcagatggagtctcgctctgtcacccaagctggagtgcagtggcgcgattttggctcactgcaacctctgcttcccggattcaagcgattctcccacctcagcctgccaagtagctgggactacaggcatgggctaccatgcctggctaatttttgtatttttattagagatggagtttcgccatgctggccaggctagtcttgaactcctgacctcaggtgatccaactgccttggcctcccaaagtactgggattataggtgtgagccaccatacctggcatattttggggaacttgacaaggacagggacttggaggttcaccttcagtaggtgaaagtctcttgtaagaatgttgaaggttttttttgtttgttttctttttttttttttttttgaaaaattattgtcaaggactctccctgcattccttccatcctctttctcagtgacctcttctttgtcattgcattcttgggttttcttttacttcattaccctaaaaaattatccttcttaattttgtcctctatttgatgaaaatatctttgttgatttttttctggttataaagcacaggacaatggaacagaataggaaacgcaaaaataaagctgcacacctatagctatctgatccttgacaaggctgaaaaaaaaaaaaagcaatgggaaagggctccctattcaattaatggtgtgtgataacctgcctagccatatgtaggatgaaactggatgcccaactttcaccatatacaaaaattaactcacaattaaatattttaatgtaagacctcaaacagtaagaatcctagaagaaaacctaggaaatggtattctggacatcaaccttgggaaagaatttatgagtaagtcctcaaaagcaattgcaacaaaaaacagacttgacaagtggaaactaaaccaaagagcttctatacagtaaaagaaactatcaacagggtaaacagatatgctacagaataggagaaaagattcacaaacgatgcagctggaaaaggtctaatatccagaatgtataagagaaacaaacaattcaataaacgaaaagcaaataaccccattaaaaactgagcaaaagatatgaacagacacttctcaaaagaaggtatacaagcagccaacaaacatgaaaaaaatgctccacatcattaatcatcagagaaatgcaaatcaaaaccacaatgaaataccatctcacaccagttagaatggctactattaaaagtcaaaacaacaatagcaacaacaacaacagatgctggggaggctgtggagaaatggtagcacttacacattgttggtgggagagtaaatgagtttaaccactgtggaaagcaatttggagatttctcagagaacttaaaatggaagtaccatttgactcagcaatcccattactgggtatattcccaaagagaaataaaacattttgccaaaaagacacatgcactcgtacgttcatcatagtattacccataatagcaaagacacgcagtctatctaggtgaccataaatggtgtattggactatctccttgttggtcaacctaaaataaaaaccttttctgttctcaaaaaacaaacaaacaaacaaacaaaaaaaaagttgcacatatacaccatggaatactatgtagccataaaaagaatgaaatcatgtcctttgcagcaacataaatgcagctagaggccattatcctaaactaattaatgcaagatcagaaaaccaaatactgcatgttctcacttgtaagtgggaaattagcactgggtacacatggacataaagatgaaaacaagagacactggggactacggagcaggtagagagagcgggggacaagggcttcaaatgatctattgggtactatgctcactacccgggtgacaggatcatttgtacctcaaacctcagcaccatgcaatatacccatgtagcaaacctgcatatgtaacctctggatctaaaataaaaagttgaaattatttaaaagggcataattgtaaaaattcaagtaatacgggtatgtaaaaataatcacatctaagagcaaaatgccctattaatattttgggattcagccttccagattttttctgtgcctgcatatacatgctcacatacatgaagtgttttgtaaccggactatattattcatggtacaacattaatatagctctgtgtctatttgtctttaaatacagctctattgcatttgtttttaaaagctgcataatattttttaaatgtagtaattcatttaccagttctataggtaggaccccaggtttttatcaactttgcttaacaaccctgattcatgtatgtaatatctttacacaattgcctggtcattgccttagaatgaagtcctagaaggttaatggctgaagttaggtatatgaacatttagttttgatgcatattgataaatttttctccagaaagattgttcaaggccaaattctcacaatagtttacgagtgcatagttctccatgtccccaacaacaggggataacattgatctttatactctttgacaatttgatgggcacaaaaagacatattgatgtttaaatatgtatttctttgaatatctgaggttgagcatctttttcctctgtatattatatcccattgtatataccttttgagaattgcttgttcatgttctttcccatgttttccattggaattttcattttaagattaatttgtatgatctgcattgattgagaatattaaccatttttatgtcatatattgtgtaaagattactccaagttttatttaacactgtatgtatctttgattacagtgtttttgtccatatgaagttttattttttatgaataaatttgttaattatttcctttaagatttttggccttgatgacaagctaataatggccatcttcactccataatggtaaaattaaatatacacaaatttgatattacacatatagggaaaatataaagtttacattcataagtaatgtgtgaaggagaagcatcttgagttcagcagctgggaagatattttaatatttcaaggtttggggtgatagtatcagttacctatgtgattgccagagcaagtacgagtgtcagagaaagtactctcaaccttaggatgcattaatgaggtgcagaggctggagggtgagggtaagagttcaattttattctggtgatttgggacaccgtctatatttagatatggtggagaacttcaaaaattaggttatgtgagacttgattgaaagaaacagaggacttttccagaaaataaattactctttggaaacatgataatcacttttaaattttttttgaaaaatttttatgtgaaacacagatcagattgattctaaatttcctccagggataaaatcaatgtgtctaagatatagagagataggcttctatgcaatctaaggtagacttttctaacagcagaggtcccactaggctgggttgggtgttgtcagtcctttgtcactgggtgtatgtaagtaaagattgaattgcctctaagataggttacaacttcatcatctgtcacctagattggtttaaaaaacaagccttttaatgggattccctttctccagttcacccttcttcaaacctatcctctatacagttatcagacagatacagttaaaaagcaaaactacttcttccacttgtcttcctgaaattattcaatggtttttcataaatttcaatccaaacagcctaatcatgtctccaaagcctcctgtgaaccactgatggttttcccttatctccccagttcactatttattctcctgcaacaataaactatctataggtcatcctgtacaccatgttgtttcttatcttgatgctgggatgcactgctttgcttctttacctggctaatttctatttttcatttaagtgttggcattaaacatttaagttccctctcctccaggactttctccttaatcactacccctccattaaaagaagggttagtatcaacatctccagtgtggtatgtagtttgaaagggatattctatatgcttaattgttttattacacctaataaaaacaaaaggagaaaatatttatacacctattcaatgtctgtttattgagaacctactaaatgctatatgctgtgtaaagtgtattttatatgatttttaattctcccaacagttctatgaagtggtcattgttattatccacattttataggtgaggagatagaggtttagtaaaagtaagaaacttggtcagttaggaccatatagctaataagtagtggatacagttttcaaatctaagacttttcaacctactcttcctccctctctcttttgtctttcataaacattgcccctaacaactgttttgcatgtctgtctgtgttcgttcttaagaggacctgaaatgccgcaattggtaccaatactgtgtgaaacagtaagaggtaagaagttttgagcctgggttactcatcaccaagctgtcaaggaggtgcacatgtcaaatggaaaaaggggtggggaaggggtgtagtccctggaacaagacgatgctctagtcactcacagtctcactggtggtaacctgggaacatactctgtatggtggatcattcttgctggtgtaataaatcaggcatttaaaagttgtgggaggaacagtgtctacaaaaatgtggaggggaaaaagcatctcaaagggtggggctttgaatgggaagagaagtggcctgagagtatatacagatttccggaaatggtcagggagctgactcataggtgggaattgaacaatgagaacacttggatacaagaaggggaacatcacacaccggggcctgttgtggggtggggggagatgggagggatagcattaggagatatacctaatgtaaatgacgagttaatgggtgcagcacaccaccatggcacatgtatatatatatgtaacaaacctgcacgttgtgcacatgtaccctagaacttaaagtataaaaaaaaatcagagatgaagacgtctgggatagaggcatgtaggtgaatacaaggcagtgggcacaaagttgaatatttttgcatcacatgccagtgttcacatttgttaatgcattcaccatgagataagctctaagcagccaagtagacaaaacaacttgaccagttcgcatcagccagccttcatcactggccatcccagaactggcatagatgtgaataagggatcatggtggcacagatggaggctacacattggcttaacggtgtggactttcagttattaaggctgatctggctactgccacctctgaatgcccaacctaccggcaaccaagatgaacactgaggacatattatatcattatctatcatggaacctaacaggcttctttgtgcaagtgtccccatgaccaggagacccactggtcatatcacataccacagtatccagaatcagtgatcgtatttcacttcttacatcctccagagactacagttcatcctcaagggacagatatttattttgcgtatggttttgactttttagtgtacagagcctcggtcagcaccattatcttggagattagggaatgtctcatccatggtcatggtgttattttctccatgaaactgagacctacaaaggtttcataacttgttcaaggttgcacatccataaaggctgagaactgcaatttcaactcagatcttgggtctccaaagcccattcttgctctaccctagcagggccagtatagttttctgcagaaggtacattgactcaggtccagggtacttgatttggccactgtgtaagtaaacctgaacctgaagaccctcataaatcctccttctgagacacaggggtatcttgggaaaagcctccatagatgtttagttcaaagcaaaacatgaaaataaaggaacatccactttcactacatcatgaatttgaatttcaattgaattcaattgtgatgttggtgactttttcttcaactgcttcatgggggtttgtctttaagttttaggccagagatgggtgattaggtggaaaaatctgtaccagcgccaggcttggtccagctcccaagcttctaatcacctctttcaggcccaatccttatctgagaaatgaagttacaatttaaacagagtcaggtgtgtgtgtgtgtgtgtgtgtgtgtgtgtgtgtatcaacaaatctcacttcttgtcttttctttctaacctctgatgcttatgtcttagaaacagccttctgtgctgggtccttttgggtcatctgccttgagttcatcttgtgttaggcttgtattagagggcactctttttatggtgacagaagcccagcttaaactgtcatagaatttaccagcctatataagtaaatattcaactagattcagagccagtaggaatgagagtcttgaatgccaccaggaattcatttcttcatctctcttctctgcttctttcagcctgtcagctttattcttttaagactggcttcctacatttagttggaattacatttcttgatagttcttatgccttacaacttttatcttcatttttttctccgattttcatttgaaagatctcaaggacaggttctgattgagtagctttggctaagtgtccatcctaggaccaatgaaatgtggtctgatgggtggaggactttgattatgctctccctgcaatgcgatagtgggagtgtgaggagtaggaactctccaaaataaggaggatggtattgccattccagaagaaaggatactgaacagacaaaaccatgacacctatgatggtgacctgccataggtaagctgaatcaataatgccaggatcacctgctaaaataattattatttttttcttctcaaggaaacattaattttggagcatggttaatattgtcaatgatgtcttgctcacctttgtacttttcacaatgattaacatagtgccttaaacagaagaaaaaaataggaagagaaaaaacaggacaaatgatggatttctctttggggacaatgacatttattctagccattaaccccttattggacatcttcaggtgtttcttggttgcacttgctcccctttgctcaatccagaaaacacaaagaagccttttgcaggctattttagccgataggtctcagaagttgcctatgcactgcatcatgggtaaaatttgggttaaagataattgtaaatacggtattgatatcaactgatgttttcccaacattgcaataatgcttgttttgtttgttggagagtttattactttttgatcaatagaatgtgagatttgtgggtgaaattagcatagtgaataacaattaggcaaaaaatcaatgggattcagacaaatatgggacaattttctctctctgtctctctctctgtctctctctctgacacacacacacacacacatacacacacacactttaaaaactgtaaggcatcttatttacaattccaaagctctaggtggggatgggagtatatatggttcccatgaactagaaacaaataggtaccaagaaaccgtttgcagattctgttttcaggacacttaagatctttgtatgctgaaaaacctggaacatcaatatccattaattccttttgtactctcttcatttttagtttaattaagagtcactgaatcccttatctttatcacctctcgcctgggtgctgtggctaagaggtaaagcagatagaactctagttctcccatagtctcacttttatttcttttcttctttcaacattatttcattggtggccaaagcaaagcatttacatactatgccattgaatcataggcaatgaaattaagagagaccccagcaatcacgattcaaatcactcctaagaatgggacagaaatccctgaaactagagtttgtcctcaagcattcacttgcgtatttctaatgacagggaactcattacctcccaaggcaatccattgtaatgtggcacagctctgatggctagaatgtgttcccttatattatatggaaaactgttccctgaacattctcttattggtcctggttgtcctccagagtcaaaaaaaacaaaagaggaaaaaagaaaactgtgattgatttattgccttgtgagattataggccatttcctgtatttttttctttaagaaaaatggtcaaggccaactattatatcagtttttgaacatcactgtattctaggcactggagtaagaacttttcatacatgcatcatctcattcactcttacaccttagcacagaaagtaaaaatatgtacagaactcaaatacttttcagtatctgcatttacattgaagtatcaggatttcctctggctgttggatgtgaacagccttgaagggaaccacactgaaacatgttccatttcccttcccttctgcttgttggacagaagaagccacaggagtttggagaatgggaagaaaaacttccatttattttacagatttatttttctctggagatcagattaatgccatgattactgctctgtgcaccttgtatgtcctcaaagagatgaccccacatttctgtgaatgtccaatctgatgtgtgagccgtctttgactctttgttgaaagatggcaacctatctgcaaaggagaaccctctgatccagcatccacatcccgagtatccatccattctgagtggagggcattttcaagcttcctcaagaaacgcatgttgactgtgagctccttaaaaaccatgtttcttcttgtctcctgagcctctggaaaatgtggttcggataagttactaagtatatatttgttggattaagtacgatgattgggatataatacagttctcagctcttacattttgtggtgtgtctaagaattccctgagaacatcagtgaagtgtatttacagcattggttcaactcctggtggactctaacatctgtgtatcatggtatttgaggattccatggggttcgttgccatgtctgagaatcctaactatatatcatcctatctgataattccttatggaatatctctgtagctgagaatttccttccactgcatgcctgctcagaaaacagtgtttagaataatggtcctgcttggctctgaattgggctggttaataatcattgctggggaaatcaatcaaatctatgatatcttattacttacactaatttaatcacagggaacggatcactgttccagttcaaagggcaaaaattgtgtgtgtgtggagggggggtgtatgggggagagagagagagaagagagagattgaagagcagagggtacgttaagcaaagaaggtagtgaaaccctggagggaatgacctaatctctacaacatatcatatgccatattcagctgaactttaatttgtacctgaaagcatgttacttttattccaattgtattctgagaattgtgttctgaataatttttgagatcagagaaggcaattgctaattccctaatcatacaaattaactgagtatgatttttagtaaaattgctcacatgtgattactgcagccaaccaagctggctccatcctaggcaaatgagtagatgacagccagccaggatggagaccatgaatatgcaggatcaatgatggtccagtctctccaggtttatgagttagtctgtgtcaatcttgtacattcccttttatcacctttctgtccaccctaatctcaaatgccacagcctccatgaagccttttctgaagaggcccccaatcaggtgagagctcttcctcttcggaatttcactctcattttgtggctccagagtgggtgctaattacgtggtctaccccatctttctttctattgagcaatgccactctcctggtccatggggattctggtggaggttttagccaaagaccccgctcttctggcccagactggccagtaaaaaacccatgttcttggacacagaggttggtccgggatgagctgatcagaatcctcttttgattatcctgttgagtttggaggaggagacactcttgagattgcaaatagcaaagaccaaaaagctacagttttcatcctggcatccctcctgtttttgtatggctctgccttagtcctttggtcctgttttgtaaaatttcctatcttctcactggttctaatatagagatgatatttttttttttctcaagacccaagcctgattgattggcagagactgctgctggagtaatgtgttaagaaagagaccgggtcatgcctagggtcaaggtaatatgtagggtcagcaggaagagattgtgatctattagttatgtcttacatgggcacaggagtggttgtaaacaaaccaggtgtttgccatcctttatctagtgacatatcctatttcttctcagtgattggtatgagtcctggatttgggcaacaacctatttctatcacttgtcaaatttgtcaccaggaaagccacagtggccacctcatgaaccaggtcaaccagacttttgcccttcagactttaacattaattctttgggtcctcgaaggctgaagtcagtcagaagaataaatgacgctacattctgacaaattcaaggagtgtgcagcataggctgggaggcccaagattgtaggcccagggcagtccatgcagcaaattcacttacattagctttccaattcaatgttcaattgattacttttgtgtaatcatggtccactggggattttgtatgatcatttgtgaccagagaccatgcatgcgttttttttgctattgcatctcctatgcctggtacacagtaagtgctcaataatgtgttgaatgagggaataaataaatcagcaaattaatgtacaaactctctagctcatatcagaagtcaaaactgattcagaattgatatttatggaatactatttgagctgaagtagaaggatctagaaaggatacattcagtttttatatttaggatgtagaaccaataggatttggtggtaaaaaaagataatgctaggagaaagggaagagggcaagaagtctcccagatttatgactggagcaatgagtggctggtagtggcattcattgagatgctcttccaaagcacctgtgttggccttgtcataagaacttctcatactctatttttattggctgagtatttctcttcctttcaagccaggtagtacattgagggaggcactgtgcctatcttgtatagaattgcattcccagaacctagttcagtgctgggacatagcaggtcagtaataaatactgagtaccacacgtgtgttggtaccaaatagccattgatgatgatgaaccacttaataagtatataatgacactgtatttccatttattatgacaggggcacatgttacctaaaagcaacttccagtcacttgtgaaaaggataaggtgcaaaccttgtttcacatagctcagaactgtcctctggtctagtgtagacctgccaatctaccatggtattaaaatgcaaattttgtatgagcttcaattactgaaagtctatatgaagtttatgaggcttaacccatagctggttcctgttcacagtcaaaggccaatgaatggtcaataaaagctgcaaacagctttccgttattcctgatggatttctctgtaagatgacagagtgtaacaatgatcaatagtggaacaaccatttctgaaggcctcttgtgtcagatagaatatattgatatgaaggagggcagcatcaagttttgttggtatgtcagcctatggttttgggtaaacagaggatagctcctctttaataaaataggatagattatgtttgagtccttccaatagaacctggcacatagttggggctcaacaaatgtgcctgagataatcatctcggaagagttggtttaagagagacttattgagttggttaaggggaacatattggtgagtattggagcccagggattagttgtcactatgtcctcctcctgtccaggaagaaaatggatggaagtggcattttctactaactgaatgatgaagatagcttctttttttgtatttgttacagaaatgcccagtgctgtctggtctagtctgattttaggaggatcagaattgaagatttatccaaggatgctgctatgtgatgaacagagaatgtgaggactgctattctaggagggcacgcagtatcatctgatgtacaaatgtttaatttctcagtgcctcaagattttttgcagacagtaatgattggggagcaagtaaacaatggcccatttatagatatgagaggtctggtcttcgctggtcttcgcaggtttagtaatcatgtgctgttaataatcctaacaacacagttacgatcatttagacagtggttctcagtcctggctgcacagtagaatcagctgggaatcttggaaagtacaaatgtgggagtcccattctagaataagagctctgtgggtgggactgggtatcagattttttttttttttaaagcttctcaggtgattgtaatgcacagccagggttgaaaaccatcaattggcccaatagagaaatagtgaaattcagcagacactgttattttctgactctattgaggtatcattgacaaataagaattgtatctatttacagtgtttcatgtgatgttttgatatacatatatatgaaataattactgtagtcaagttaattaacatatcaatcacctcacatagctaccgtgtgtatgtgtgtgtgcatgcatagtgagatcttctctcttagcaaatttcaagtatacaatgcagtataaattaactacagtcatcacgctgtacatcagatacctagagcttagtcattgtgtgtaactgaaactttgtaacctctgaccaatatctctccatttccttcaaccccagtccctggccaactactattctaccctctgcttctacgagtttgacttttttaggaaccacatataagtgagatgatgcagcgtttgtctttctgtgtctggcttatttcacttggcctaatgtcctccaggttcatccatgttgcgcaaacacttttttgatggagaaaaactgttttatttgatgactaactaggcagtgaattcctttaaatgggattggaaaatctttagaattagatattgttaactaaataataggtagctggactttggggtagctgatttcattgttgtctatgccctaggaagggaacaatataaaaattaatttgtcccttgtccagacactggttgcaatcattgcctaggattttcaaactttgaggaaggctgacgagcgtatggtgattaactggcatactatagatctattgagaatgcttcgaagtatgtagcttctcaaggaattctaccccagcaagacacaggggaaggctgtccttgggtgtgggaacaagaagttggacttaggagttaacacttcagatggtaattggaggggtagctttcaaagcctctcgtttttctgaatcaaaaagagaaatggttggtgggaggaaatggccctgtgctggttggcatacataggttaagagaaagaggagctcttgttgcatgtgactccgtggttaactttttatatggataattgttagtgaaaacccccatgggatgttagtagctatgacttgatgctgtggacagccagccatcacagataggttcctacagggctttgctgtgggatgaggatggctcaccaccctgtaactggctcttaaaagggagccacgtgtaacggctgatcaaagtagcaccaagaagggctgatatttatttgttaaagagagaactaaaattttccttgtcatttgtagaccacatttttttttaaaggcctgctggatctgagaatatattttttggctactggttttacttaatattattattaatgggtatgatgggaactaaacttgtttcattattttaagtaatcaactggcctataataaagagatattaccaagtaagtattattcaataaaggaaaggattgtttctattaaaaacatgagtctgtatatccatgatcttgtgtatgtgtctggggttatgcgtctttcaagactctcagaatgggtcagttcattcttctcgtttgactaatgagtctactgagacttgatgggagtatccagagagctattaaataatgtggaaattgagctgattcattttctttctttctttctttctttctttctttctttctttctttctttctttctttctttctctttctttcttttttcagacagggtctcacactgtaattcatgctggagtacagtggtgcaatcatggctcactgcagcctccaccttctgggttcaagcaatcctcccgcctcagcctcctgagtagctggaccacaggtgtgcattgccatacacagctaatttttaaaaagtatttttgatagaagcagagtctcaccatgttgcccaggctggtctcaaacttttggcctcaagtgattttcttgctttggcctcccaaagtgctgggattacagctgtgagccactgcgcccaacttcattccttttccctagaggattctttgcagggaggataagtgaaggaagaatcttgctgtgaagcagaacctctatgaggtcacacgatgatggctctctgcagtatgaacagagagagagagagagacgaaagggcaatcactgtccattctccctcccattgctcctgagacctcttctttacaatcaggcctccgtgctgctgccctccttgtgctgtgtctctttgtgtgagtggatgaagtgactgaaggcagatccagggagcagaaaagaagtcatgaaagggaggaccagagggtgtctagaagggcatctactagtcatttgatggcctgtgcgtatttggatagaatccagagaactattaaaagtgcttcccaagagagccagattgcctgggatcagatctctgttatgcctcttattagccatgtaatctcaactcttagttttcccatatgtataatgggatggtgacaacaatagtcaacctcatagggctattttgagcgtgaaatgagatattacttgaaagtgtttagaatagttccaggcacatagtaagggttcaacataagctagttattatggcttttatgagattagctgagaaattcaacatctatgacttcctaaggtggatggtcattcgttcgttcaacaaatatttgctgaatattactgtgtgtcaggtctcatgccaaatactcacaaatgaattacaaatggcctctctttgaaggagcaagaaggactggtttgttgtttatcccaggaatactccagcaagcttgtacaacttgccttattttgttgttgtagttgttgttttgctttgttttgctttaggcttttcacagcctgaagccatggtttttagtttctgtctctagtgataagtggaaatgggggatgagaaagggctttactggcccaaccagaaagagaaactaagaacccataagtgtattctctcccttggatacccctaaggggtagacaatcaaaaagaaagaacggcaaaagaacagtgtattcagcagcccaaatgcacatggaaacctctcatttttaaagaggatgaagccgtggaggccggagcttctctggggtctggtgtcatgatggtcacaccagcagtagcagcctgtgggtggggaggggacagaatgaccccaggcctttctctttcctgtaatctagatgtgaggcttgtgaagaaatttcctaaaagcagcctattgaactcaagttccccatctcagtctcagagaagtgggaaatagggcctcctttcacagactccaagggcaggaattttcgcctttctcatgcaacaagcagccagctccttcaggcctcatagaagtttcagctactgactgaggctggtttgggataagaaaaacatcctctgctgaggtctcatggggcctgggtcaatggctctgaactgcagggagcttcgtgggggcaggctgctgtggtcctagcttgctttagattgtaataattagagaatctatacttggcagaggtgagctggatcatggagataatttcgttcaatcctatcattttgcaaagataatcctttacaactagagaagaccaagttatccttattctctgcccagttctgttccttactcagcaaaaatctcttctctctactaatagttcataggtctttgtccaccaaaagtccataaggattctgcctgattcatttgcatatgactcatatgctaagagcttcgtaccaaaatgttaagtgtaacatatttgaactacactgtgatatttcatcaagagttgccaaactatagcatggaatatacaaaaatgttcacttcaagttattaaaaaatttgtcctttattacttaacgtaaagttggagtccattataggaatcatctctatcatcaccattgtacccatcatcatcctggtgatccccacggatcatcagcagcagcatctctgtcatcatcatcatcatcatcatcatcatcatcacaacagataacattgctagaccagtggttcttaaagtgtggtcctacatcaaaagcattagcattacttggaaagttgttagaaatgcaaaatcttagagcccattctagacttaataaatcagaaattctggagtcaggcccggaaatttttgctttaacaagccctccaggtgattgtgagttggagaaccattgtgctagactgtgccaagggcttttaacaccttatctcacttattccacagaataacccacagtgataagtaccattgttgtcttcattttaagaaaactgagacagagtgaagttgagtaacttgcccaaggttccacagcttgtggcatgaggcttagctagagcctgtaatgcatttactttgttgcacataatacattttcttctttttaatttaacttttaatttattttattttatttttgagacacagtttcactctgttgcccaggctagagtacagtggcatgatcttggcacactgcaacttctgcatcctgggttcaagcaattgtagggcctcagccacccgagtagctgtgattacaggtgtgcgccacaacacccggataatttttgtattattagtagagacagggtttcaccatgttgtccaagctggtctcgaactcctgacctcaagtgatccgcctgccttggcttcccaaagtgctgggattataggcgtgagccgtgcgcccagcctaatttaacttttaagttcagggatacatgtgcaggtttgagaacacaatatatttccagtgaagtcaatatctgtgactctgcttatcctaaccaattctatgaactacaaaaaagaagagtagtaaatcctttaacagccaatccctaacaatatcatggaattgcaatttatttttactcagcttcatcttatgcagtctataaccacaggcttgaggtggtgacatgccttcaaatcctgcttcatcttcccttgaagtaaagccaaagatgatttcctgggcagaatgtggccaatgaggtctgcagcagagagaacaggagtgggcagagggggatagggtgggaccagctgcaaaatacttcctgagtacagaaagaagggatgaaggagaaatgaggccagaagagaaaataagttaataagcagagaccactattcgatgaaacaaatactgtgatatccattgtactgacaaactaaaacctggggaggttacatgacacatgcgataccagtaacggggaaacagatgatctgggatttgacattggtgtttcgactcttaatccagtgcttattctactatagcgcaactggagcaactgaagatgaaaaccagccatatgaggttatgatgagacacatgtgggaacatatgcccttcttggagttcataaaattccaggagttgaatgaacccaccgaaattgaatgcaaagttatgatgtcgtggtgtatgtgtttattttatacttatatacacatgtgtatgtgtgtatttgtgtgtatatatgtacacacacaggtatatacacatatataaatctgtattagtcagtgctctccagagaaatagaaccaagaggttctatatatatattttttgtttgtttgtttgtttgtttgttttgttttctgaaacggtctcactctgtcactcaggctggagttcagtggcctgatcttggcctactgcagccttgaccttccaggctcaagcgaccctcctgtctcagcctcctgagtagtgcaccaccatgcctggctaatttttaaattttttcatagagatgaggtctcactatgtggcagagtgatagatctcattatgttgcccagtgggcttaagcaatcctcctgccttggcctcccaaagtgttggaattacagtcataagccaccacacccagcctgtaatgagattgacaataaggaattggcttatgcaattatggaggctgagaaatctcatggtctgccatctgcaaggtgaaaacccaggttagctgatgtgtagttctagtctgagtctgaaggcctggcaatcagcagaactgatggtgaaagctccagtccacgtccaaaggccttagaaccaggtgagctgatggtatgagttccagtctaagtgctgcagaagactgatatttggctcataaacagttgagtggagagagtgaattatcccttactctgtttgtttttgtgctatttgggcctctaatggattggatgaggcccacccacattggagagggcaacttgctttactcagaatactgattctcatccagaaatatcctcacagacattcccagaaataatgtttaaccaaattatctgggcaccctgtggcccagtcaagttaatgcataaaattaactatctttctctgtctagtggagagagagagagaaaaaaaaaagagagggagagaatgactttcctatttctattcccatatgggtcgtggtagattgcattattccaaagatggccgcttgcgcgcgcgctctctctctctctctctctctctctctctctctctctctctctctcccccccctccccctccccctccctttctccctccccctccacgcactccccatctccctctctgtcccttacaatctaatcagcagtcttcctacttagaggtggggtttgtgttgctttttccctaatttggacaagggttgattaaagctccaacaagcagataatggagaaaaatgatatcctgtggcttccacggctgggtcatcaaaaggatacagctccttttctctgcctacacacttgtccttggaaaccagccacagtgctgccgggaagcttaaatgagcctgtttggagggacgacaggagaggggctgagatctccccagtcgacagcgagcatcaactgcccctgtgtgagtgagcgtttgaatggtcccagcctccagccttcaagcctgagaccccagggatggtgcagcagaatcaagccatccttgctgtcccacttggactctgacctacagaatctgagagcacaatgaatggctgttttatgccactgaattttgaggtgatttattacacaaccctaataacaggagcactacttccaatctttttcccaccctgtagcccagacgttctttctaaaatgttactgtggccctttcatggctcagatcaaggctgttctgtggatccctattggccacaaggtaaaggtttgtgaaaggaagctctctgcctattttctcagtcttggaactttgactatatctggccgcaaccacaaaacaccaattcagacctatggagctgctttgggttccctgaagccattagtttcccaaacctgtgtctgagcaataaaacacttagtcatgaagcagttttcacaggtttacagcgagaaaggctgaaaaagtagaatttaatttttatggtaagattttcttttaggtaaatctattaagttattagaatggtttccatccccaaccttcttttttacttcctaaaattcacgtttttttctaatttttttggtgctaaaaatgtcctctccttaatgaaataatgggactaccttgtttcctgtctctgctcctgctgtttttctgttaaagtccttactaggcaaaataaaaagttggtcactaaatgctattccctcaattaaaaaaaaaaatcctgtacttgaaataaaagtctgggaaccactgacccacatagtgtagtctaaaccacttagcatggcattaaatccttgatgccatattagttaaattctgttctaattgtatgataattgggtccaccaacaatgtgattccacactatgcccctcaggtaagtgatgaatgtctgagaaaattgggtgcttggtggagcattatttctttgagaaatatgtctgaaggcacaaaccattgacttaggttaagttttaaaacactgcctcctctgaagttaggcgttgctagctcataaataattaatacaaaccatatagccactcagacatacatgtgtgcatacctacatcacacatgtcatcactcccacactcatattaacttcatacacccacactgatgttaaaatgcctgcacacccagacaaacatggcagctggagagatacagagttctgcaagtgatccagcgaggtgactaagctaagctgtgcttcccagttcccatccattcccatggagatccatcaatctccacgtatctgctttcaggagctcttttccccaaagtccttgaaataaatttgtagcctgatatttgagaatggccagtctgagttctacttacataactcacccatgcccttgacattcccccttggatttgtccatgcacagctgatccatcccctggaccaggacaaggctacagctcagaggccctctggtggagaaaatacttgtattttttttttttcctggacttgcagctatctggtcttgcttcagttaatcagtttcctgccacctagctgggataatagttcatcttgggtttgttgacctctgtctcttccagttgcctggtgtttggtgattcaaagggtgataaataaacaggattcataatcatagcatgcatgattaggaacactttctgaccatttcaatccaatttgcatttaggtctggttaacctgaggggcaggcatgttaatctttacacaatacggattgattactgacttctcaaatttttcctccttcagatgacaagccccagcagcctgaaatttgtcaatttaagatagcacccaaggagcacaacaaacctactttaggaaaaaaaattaacttggaataaatacattacttccgtgcagagcaagaacataaagttataccccagggacaggcaccacctataacctactgcacccctgcaatatcttggtgcctcattagatttattaatgaggctggcacatcactctacccagccctattgtttaataggatcggtggacattgaccagcacagatgataaatttgagagaggctctatcagcataaggtttgggactggggaagcagatggaaatgttttcccttgacctcataatcctttatgtgtcttccttgtgatgacattgtattatttaaagtgcacaggatctatagcacctccttggaaatgtctaggaatctggggatgagtctgtgacctccatggaaaatgttaggaattctatccagatgtgcaggtttctttgctctggcccatgcttaaccatggaactgcaaaaacaggaaagccttagaggtgtttgtgatatcataaggtacttgcatttttcaagagcataacttggactttacatgcctctaaccctaactggcatctcttatggtgcttagcaggtgcctacagaatgtttattaaatagatggactttggactgttcaggggcttgatgagttccttgctatcagttgagcaaaagtagtagaggatgttttattccaagaaggggaacctgggtggtctctgtgtgtgtgtgtttcttttctatttgcttttccctatcatattgaactcattaccttcatcggggctgttaggacagattcctgactattccccctctccattggaggtcacttctcatcttgcttccttgatttccacaagaggaagttaacattatcctgagtgtgactgtcctgtggcatttggagccattcttaaagtacaacactggattatttcatcacaagcatttgccaatgattataatcgagggatcatgacccctcagtctcttttacaatgcctctggagagagataacattcaaggaggattgcttgcttcaaggacctgtaatctacctcttcttccaagtattccaaattaaaaaaaaaaaaaaaagggaaatagagagctgagtacttggacattgtgctggttccctttagatctgcttccatggaatggtcctttgatagaatatattgaggttctgataagaaacagatctattaagttatagttaagtccattttaatgatactattaagtggtgtttattatagcataccttgtattctttataaagacttctgggagatatttttatctggtttcagtgccataaaaggttggctaattagcaaagagtaggacctttacctttatgagcttcataaactttcgtaagcgtttagtttgtgtgtgtgtgtatgtgggcatgtgcatgtgcttatttcaaaaaatttccaaagcaatgaaatgaaagagattttccctgaaagaggaactattattcatccttgaaggcctatcttaactatatggccttgagactttctcagtggctgctagggaggtagaaacttctgcctctgggccccgggaccactctgttctttaaagtcatcagttgcaatgtgcttggatttgtgtggccatggctgtcagccccactcacctgggagcttgtaaaagacaagacaaggccttctgggtagcccccagaacctcaaacacgggaaggtgcattgtcacttagacattttacctcagcctcttgatcttcactgacttgtggactctcaagtatgctttgtctatgtgtaattttgtaatagagcgttggaagagagactggcatttttggataaattaatctcttagtgaagaccttgtagttctatttattctttctagtgaaatgtgtgtgtgtgtgcgtgcatgcttgagaaggagagagagagagagaatttgatttattaatcaagacatgcttcagttactgaatgggaagaggaccaagagtctttgggcttataagttagatttgacccacacatttacaatgcttctgcttcaagaacaaggtgctcttttatattcttttcttaatgaatctgtgaccaggtcattctcatttttggattttagaacaggtctattcgagataaaaactgtgcccctgaggtttgctttctaaaacacaggtgtttcagatttttttttttttttttttttgctgatttggttttaattccgtcctttctttaaccacatcttttttcctttctaggagcaatacaaagttcagacacgttctgaggttgagttttggtgactttagcagaaagtcagaagaaagctgacaatttccttttcttcagtgatgtgcatggtttccaggcctttctctggacctatgattcactgccatggagtggaactttaacacccctagactgtggaagctcatccagctttcaacagtatcacctagaggcaatgaaaagcaatcagaatcacagaccaacctcatgccaagagaatcttcattcagttgtggtctgctttgtactgcttgagcatttggggtttgaaaaattaaggaaaagaatagggggaagccccaagatgaaaatactggttttcttgccaatgttttaaaagcagctcaagacttaaatttgagttgaaaatttcttatagcaaatgtgacttttgggcttctaaaaacaagtcatcctggttatgcctggttgttgaaagtctgcataattatgttatcttatggacatgtttgtatctcttcaaaattcatatgttgaagccctaactcagtgtaactatatttggagatagggacttaatgaaataacgaaagttaaatgaggtcataagaatggggccctgattcaataggattagtgtccttttaagaagagataaaagagagagctttccaccctgtcatcccccttccagctcccatgcagagcatgcacaacagaagagatcatgggagcacagagagagagggtggctgtctacttgtcaagaaaagaggtctcagaactcatcattttttatggctgcatagtattccatggtgtatacgtgccacattttcttaatccagtctatcattgttggacatttgggttggttcctcacttttgttgaatttaataaatttgaattttaaaatctaaaaaaagaaaagaaaagaaaataggtctcagaatgcaacccacattgctgccatgttgatactggacttctagcatctagcaatgtgagcaatacatttctgttgcttaagccatccagcctgtagtatttacagtaccccatgctgactaatacattaatcttagttagagaatctgctatttatagggcaataaatgtgtccaggcttggtaattagagagacgggggttaaagtcttgtctctgccatttgtttgctgtgaattttaggtgcattttcttgcttctgagattgtattccatcatatgtaaaatggagattttaataagaccttcagtgtaaagattaaatgagataatagataaaaatgcaaatataaatgagggactagcatagttgataatctgaccaataccatttatcgaatgtctgcctgagcatagtagtgctatcaggtttattttgatgtggccacctcccagaccctcacccccacccagaattggaggcaggagaattgaaatgggaaatatctttctgattacccttttcctcacaaattgtaaccaaaaggattttcaaaaatttcccctaaattgttatggtactaccttagggcaacatgctttatggtctagctgggttattacgaaaaatatatttaatttttttctccagatccctggagaaaggagatggtactttcaaacagaataagagaactttgaagagacttaacaaagggactagttccaaaagtatggtgtggatttaaggaaataacaagagatagtgcagtattctgaagtatccaatgaggagctgttaccaccccgggtctaaagggtcaaggggagggaccagccactagaagtagataggataactgtacgaatagggaggtttgactcgagctatgactagtagtggaagaacacaaccaacttaggggcaccctggccatgagggagctgaggaaacaaatattcaacttcactcttctatcttctgatctcttcctgtcctctcattggctgaacccaaccagaaaccatggacactctggttcatacactggttgatggacgccatatgtgttagtcccctggggaatacccagcaaactggagacagtggacagtctccactgaaattgggaggttaatgcaagctatccaggacaggagtcttctcaatacttctcaacttctcagtatatatatagagagagctctatatttgatttctccatatttgtttcttgatatgttaaaggaatatagaactatagtcaatgataattgtacatttaaaaataacagagtgtgattggattgtaacacacaggatacttgaggggatggatgtcccattcttaatgatgtgattattacatattgcatgcctgtatcagaacatctcatgtaccccataaatatatacacctgatgtgaacccacaaacattaaaaattacaaaaattacaaaataaaagaatatagaacattttctttgtttcccccaaacaattctcaagtttaatatttaccctggagtgatacatttctaccttggagcagaaggctgcaaggacacgtgatttaagagaagaatgtacagacacagtgtttgagaaatactttctgcattgcactgacttgtcctgttgactcatccatggctgtgggtcctttaatcatagttctctggggccatccatatggccatatctctttgtcactggagacaaaagactatttgggcatgatctccccctcctttttgaactttttttttttttttttttttttttgagatggagtctcacactgtcacccaggctggagtacagtggtgtgatcttggctcactgcaagctctgcctcccaggttcacgccattctcctgcctcagcctcccgagtagctgggactacaggtgcccgccaccatgcccggctaattttttgtatttttagtagagacggggtttcaccatgttagccaggatgttctcaatctcctgacctcgtgatccacccacctcggcctcccaaagtgctgggattacaggcgtgagccaccgcgcctggtccctttttaaacttttaaagtttcagataattatatatttacatgcagttgtgagaaataatataggaagatcccatgcattctttacccagtttcctcaatgatagcatattgtccaactacagtataaatcaccattgggatattgacaaaggtacaatccatttatcttattcattttttttagttttacttgtacttgtgtatatgtatacttagttctgtacaattttatcacgtgtgtaggtttgcatgtctatcatcatagtcaaaatacagaatagctcaatcactacaatgatttctttttagttattttaaaatgtacaattaagttattgactatagtcaccctgttgtgcaatcatgtatgtcttattcattctttttaacatttttgtaaccattaaccatttccccctctcccctcaccccccacttcccttcccagcctctggtaaccatccttctactctccatgcccacgagtaaactgttttgatttttagatcctacaaataagtgagaacatgtgatgtttgtctttctgttaaatgaaataatccaggtaccacaatgatctttcttttttgtggggtggcggggtggggtttcactggtcacccaacctggagtgcagtgccccattctgggctcactgcaacctccgcctgctgggttcaagtgattttccagcctcagcctcctgagtagctgggattataggtgcctgccaccaggcctggctaatttttgtatttttagtaaagacgggatttcgccatgttggccagactggtttctaactcctgacctcaggtgatctgcccgcctcggcctcccaaagacctgggattactggtgtgagccaccacaatgatcttgatgttcttctatcacatctatttctttcctaacgcaccccatttttcatccttaaccccccggcaactaccactatttctataattttgtcatttctagaatgatacatgaatagaattatacagtatgtaaccactaggattggcgttatttcactcagcgtgattctcaggaaattcatccaaattattgtctctatcaacagttcattcctttttagctgagtattattccatggtatggatgtaccactgtttaaccattcacccattgaaggccatctgggttctttccagctttttgctgttatgaagaaagctgttatgaatattcatgtacaggtttttatagaaacataaatttctatttttctgagataaatatttaagagcacaattgctgggatgtatggcaattttatgtttggatatataaataactgtcaaattattttccagagttactatgtcattttacatctgtaacagcagtgtatgaatgatcctgtgtctttgcatcctttccaaagatcaaagacaagcatttggtcttgtatcaagtttttgaattttttttactcattctgataggtatgcgtaatatatcactgtggttttagtttgcatttccctaatggctaataaagttgcatatctttaattgtgcttatatatcatttgtataccctcttcagtgaaatgtctgttcatgtcttttgccaatttttgaattgagtgttgttttttactcttttgataactctttgtatattctagatactaatcctttgtcagatacgtgatttgcaaatacattctttcagtcagtaccttgttttcctctcaatagaatatttcacagagcaaaagtttttaattttgatgaggtccaatttattattttcttttctggatcatgcttttggtgtcaaacctaagaactctacctaagaacactttccctaaccccaaatgccttaaaagtttttctattttccccccaaaagcattataattttatgttttacatttatgtttgtgaacaattttgagttaatttttagataaggtatgaggttcaggttgatgatcattttcgtttgtctactaatatccaactgcttcagtataatttgtttaaaaggctatcctttatttaattgcttttacacctttgtcaaaaattaattgggtacattcatgcaggtctatttctgggttttctgttctttcccattggtcagaataaattactatagctatacaggaaaccttaatattggtagaataataaaatgaaatgaaacaatttattcttctttgttcaagattgttttagctattatagggcttgtgcctttccatataaattttaggataaacttgccttactgtatacacacacatgcaccccttatgagtacaggcatatcttgttttattgtactttgatttattgtgctttacagatattgtgttttctacagattgaaggtttgtgacaaccttgtgtcaagtaagtctcttagcgacattttttccaacagtttatgctcatttaattagcatttttaacaataaagcatccttaaaaattaatgcataatatgtgtacacattttgggggtacatgtgatattttgatacatgaatataatatttggaatattcatctctttaaacatatatcttttctttatattgaaaacattccagttcttttcttctagctattttgaatggtacaatacattattccgaactatagtcactgtcctgtactattgaacaccgaatcttatttcttctatctaactgtatttctgtacctattaaccatcctctcttcatcctctctcttcgctacccttcccagccgaaagtattttttcactaaggtgagtacattgtttttaagatataatgctattaagcacttaataggttgtagtgtaaacataacttttatacgcactaggaagctaaaaaatttatctgacttgattcattgtgatactcactttatcacagtggtctaggcctgaatctgtaatatctccaacatatgcctgtatttgataagaattacattaagccaacagatcaatttggggacaattgatgtttttactatgtagtgttttctaatccatggacataagtatgtttccctgcttatttaggtcttacttgatttccttcatcaccattttctaacttcagcatgtcttaagtttatacctgaatatttaattgctttggagttttttatttcagtttacacatgttcattgtcaactttattgagaaataagactgatttttgtgtgttgatcccttatcttgtgatcttgctgaactcatttgttaattgtagatttttttttgtaaattctttgagactttctagattaaaaaaaagtcatctgtaaatagagacatttttatttcttctttctccaatctgtattcctttatttctttctcttgctttattgcaatggctagaacttccagcactgtgttgagtaagaatgatgagagtggacatacttgccttgttcctgatctgagggaaaaaagcatttaatattttactgttgagtatgatgtgatctgtagaattttctgtggattctttttatcaagtagaggtcattctgttcaattcctagcttgccgagagattttcttttacatgggtattaaatgttatcaaatgtcttttctatgtcagttgatatgaccatctaccttttctcctttagactgttgccgatattgtaaattatatcgattgcttttggaatgctgaaccaatcctgtgtatctagaatacatttcacttgattatagtgtataactgtttttatagattgttagatttggtttactaatattttgttgacgacgttggcatcttcatgagagatattagttttccctttgtactgaccttgtctgattttgatatcaagataatattggcctcaaaatgcattggagactattccctcctctttcattttctggaagagattatgtaaaagtggtgtcaattcttctttaaatttttgataaatttccctagtgacaccatcagggcctggggattttttttagaacattttaattacaatgtcaattactttaatggttatctactcttgcagattatgtatctattcttggttaagttttggcagttggagaaattggtctgtttcttcttggttgttaaagttatgaacataaagttgttcttagtattcccttattaagttttgagagctttctttaaccatcctttaagggtgagactgttggtaacagattctttcaaagttttttcatctaagaatgtcttttttccccctcttattcctgaaggtagtttcactggatatcagattcacagttgatagttcttttcttcaacataaaaaagtgttgtgacactttcctctgacctccatggtttcacatgcgaaacctgctattatttgagttggtgttctcttatatgtaatgcataatttctttctgattgcttttaagatttgttctttgaacttatttttcagaagtttaaccatcatgtgccttgccttgaatttctttgggcttatcataattgcggttagctcagcttcttgaatgtttatggctttcatccagtttgagaagtttttagctcttatttctctaaatactttttcagctccatattctctctcctttccttctacaaccctgatcatataaatgttagatcttttgttactgctccataggtctctgagtatctgttcattttttctctattttctcctttttgttcaaattgagtaagttctatttatttcttcaagtttactgattctatctctgtcatatccacttaatacttatgactctagatattcagagtgaggtgtggcgcactttggtagtgaaggagctgaagaattgaagtggccaaattcactgtcttttcaattccagagaaaatatcaatggaggaagagattctcctacctccctggatacataacacctttaggatgtcaacagacattttaaaagctgttggtgtcagagagacttatccaggaagtgataaaggtggcttgtgagatctggaagctgaatattgttaatgaaggataaagttctatacggaaacatacttccaaacacattactcatctatttatgttctctttgcttgataatttggagcttcagtcatgtttttagggtgaatactatttacacattatttcccattgctgccatggttctattttcagggcaaagaaattccataattgggattatagaagaagaaccagcagccactgggaaaaccagaatgttcctcagatcaataaatgagctaatatttgaatgagtgagttatatggtttggcactcggtcccaaggcaaatctcatcttgaattgtaatccccatatgtcagaggagaggcctggtgggaggtggctgtatcatggcaggagatttcccccttgctgttctcttgatagtgagtgagttcttatgagatctaacagtttaaaagtgtagcactttccccttcgtgctctctcacctgccaccatgtaagacttgccttgcttctccttcactttctgccataattgtaagtttcctgaggcctcctctccagccatgcagaactgtgagtcaattaaaactcttttctttgtaaattacccagtctcaggtatgtctttatagtagtatgagaatggactagtatagtgggctaagagtggcatagaacacatggatgttttgggcatgtttctgaagatatttgatagagggaatggaaggtggatttgatcaatcacttggggcttggcagatcatatatgtatttattttaaatatactgtacatgaagcttctctgaccagaaagacatatgccgtcattgaaggtattatgtgagaacatgagctcttaagttgaaatggaaaatacaacatttgagcttgcttactttcaacaatcgagaaaagaatagagactaatattgatatttcaaacgttacggaagtgtgtgaaattaaaaaaataaacttctactcacagttcccatgttgctaatctactgtcatataaccctctgtggatcttttttcagcctattaattttatgtgatcccagtatggattagcatttcagttcatgatggttcaagacttatctgatctacaattcccaaagctaccttcactacttatccagatagaaagaaatacattattatgctttataggtgtattagtctgttcacatgctgctgataaatgcatacctgagactggatatttatacagaaaaagaggtttaatggactcacaggtccatgtggctggggagggcttgcaatcatggcagaacgcaaaagtcacatcttacatgacagcaggcaagagagaatgagacaaccaagcaaagggggtttccccttataaaaccatataaaaccatcagctctcctgagacttatttactacctggagaacagcatgggggaaatcaccctgccatgattcaattatcttccacttggtccctcccacaacacgtgggaattatgggagctaaaattcagtaggagatttgggtggggacacagagccaaaccatatcaatacacaagtatatagcggggaaaaaacagaactcctatagacatagacacaaagaaatgcatagctctgtgtcacaaacaaataatacctgaaaatggaaacagaacactcacaaagatattgtgatatcagattattatctgaatattctaatctttaggtcagagctctttatcccagcaatcctagtattgagaatttatcctaagaaaacaatctttttttttttttttttttttttgagatggagtctcgctctctttgttgctcaggctggagtgcagtggcttggtctcggctcattgaaagctccgcctcctgggttcacaccattcccctgcctcagcctcccgagtagctgggactataggcacccgccaccacgcccagctaattttttttttttttttgtatttttttagtagagacggggtttcaccgtgttatccaggatggtctccatctcctgaccttgtgatccacctgccttggcctcccaaagtgctggcattacaggtgtgagccactgtgccaggccagaaaacaatcttaaagtagaaaacacaacttcatgcctcaagaaatttattgcagattattaataacagcagagggtaagctgtatcatacatgtacagaagttgaatgcttatgtcgagtgcattgtattcatttaatgatgtactagcaaatgatcttaagagcatgccttactccatttatgcttctataacagaatactacagactgaggaatgtataaagaacagaaatttattttaccacagttctggaggctgggaagtccatgatcaaggcactagcagatttggttgtctggtgagggttgctctctgcttccaagatggcaccttattgctgcatccttcagaggggagaaacattgtgtcctcacatggcaaaatgcagaagggcaagcaggataaaatccctcagtcgagccctctcatgagggcatctaatcccattcactagggaggagccctcatggccaattacctcttacaggtcccacctgttaacagaagcacattaggcacacctgagttttggaagagacacattcaaaccacagcagagcacaaaatcagatagacctgggctcaaattctgactcctgtacgtacctgggtaagttataaatttgttaagcatatttccttttgtattatataaaatagaactaattattccttcttcacaaagttattgtaaataactaatgaaatatacatataaagcagatagtacaatgtctggaagagaggacacatttggaataggtgtttgaaaaatacagcttttgtcctgctgcttcttttataaataaagctttattgaaacacaaccgtacccatttgataccaattgtctatggttgcttttatgctacaataacagagttgggtgtttgttacagagagagcatgatctgcaaagcctaaaacatctatcaaatagctccttaagaaagtttgccaacttctgatttagttcatagtaatgatttcacaactataaaaggtgttttgtaaacaatagcaaaataaaaaataaaaactaggttatatgcttaatggaaaaaaataacctaaatctatactcatatttgatagttaaaactatgttgactttataactgcttatacagcacttaaaaggaagagaaataaaaccgattcattagatttaaggaattttaagagatattcctcttacaaatttattgtttttaaaaaagtagaagtgcaataacaattatcattgaaaaatcatgtcacctcttaaagagttcaggaattcaagtcctctctgggtgtggtcatgagtgtctctagggaaatataggcaacttcaattagaaattctctggcctatgtggttgttctcaaggttcaggtgtctactgatcagagggtaaaatgaagttccttctttactccctttccagctccttcagccagagccaaagtatttctggctatagggcttaggcttattagaaatgcaaaataagtatctaatagtaggctttttaatagaactgttcttagctgtcaaaagcaaatttatattaccacattgattagttgctgaagacttgcaaagcttctatttctgatgggattgggactgactatagttaatgttttttttttcctgttgtgttgcatattccttgtttcctgctctgtgtgtatgtgtgtgtgtgcatatacatgtatatgtatatatgtaatagttcacacatatataatacacattgtatatatggtatatatacacttttaaagggattttaaaggcatttttatggttaggctaattctctttcctcttgaatttttttcatagcatgttttatataaaggtaaaacatctaattgacttaatagcaagtttatcttttttttttttttttttttttttttgagacagagtctcactctctgtcccaggctggagtgcagtggtgcgatcttggatcttcactcactgcaacctccatctcctgggttcaagtgattctcccacctcagcctcccgagtagctgggactacaggtgcaggccaccatgtccagctaatttttgaatttttgtatttttagtagagacagggtttcatcatgttggccaggctggtcttgagctcctgatctcaagtgatccacctgcctcagcctcccaaagtgctgggattataggcgtgagccaccgtgccaagtttctttcttaaacccattttctttttgttatcattatcatggctcagttttaggtgtaacttttgatcttttctgcctagactatcccttttacatttatcagagtattctttatttaaaaagtccattatttctttaaatatattttatgcttctttttctctctcctgtccctcttgaaatccggttacacatgtgttggacaatttcatattgtcctgtaggtcactgaaactctgatacattttttgtttaaaaaagtaatttcaactttcattttagatccaaggggtacatgtgtaggtttgttacatgggtatattgcataatgctgaggtttggggtacaaatgatgtcatcacttaggtactgagcatacccagtaatttttcaagcctcacccctcactgttccccactcctatagtccctagtgtctattgttgctaccttgatacatttttcaatcttttttctcctctttaaattggataatttctaagaatttgtcttcaagtttactgagccttttttctgtaatctccagtttgctgatgagcccatcaagttatttttttcatttcagatgaattttctgcttttggatctctatttcattctgtttcatagttttcatttttctttctctgatgttccccatttgtttcctcggtttcctttaaattattgaatatatttatggatcttttcctgctaatgttagcatcttaaatgaggtctttttgtatttattattgtctagtattgtccagctttcctgcttcttcacatgtctggtaattttttattatatgctgaatattgtggattactcaatagaagttggatcgtgttgtcttcctttaaagagggttgacttttgttctggcaggaagttaatggactggtggttctccttgatcttactgagtcttggttttcagctttattaagtgggtccagaatagcccttactctagggtaagagttggcaagcttcggtaaaggaccagatagtaaatattttaggctctgtgggctacatatggtatctgccacatattcttactcattttattttatgatcctttaaaaatgtaaactccattcttagcttgtgggccatgcaaaaggaggccatgggcttgtagtctttctggtgtgtcagttaaatatctagggtattaatgagggctctgtactctggctggactgaaataccatctgtaagcactgggtgaactctagtatttctgttccactctcaacccattggcagctactttctgctaggtcccatggagccttgctctgtactttttcacctgaactcctagccaaggacctgcaggacactcccactcagacttctggagttccttcactctattaccatgctgcacacagtctaactggttcagttaatttcagtagctgcctctttctgaatttcggtggctgcctctcccattcagtaggaccatcctgctctgctaaagcttgctacctatgtgtgccatggttaggaaatttttcaaagacaaggatcagagatggatttagacttctcttcctatgtttcccctgcctataggccaatgtctggaaacaactgcctcagctatgcctccgtttcatgcttacttatcacaagaggtcaagtctggtactgattactgtgttagggctggagagggaaatcccacggtggtattttagaaaaccatttgacaatatcattctcatgcttcaagtccttgaatgactccttttcacaccaaggataaaaatacaaactcctaaactttgtgcccaagattcttcacaatcttttgcctatttacttcctttgccccatcttctgccatgaaccctgtgcttcaggcatactgagctttgaaccaatgccccaacatatcttttatgcttctgtgagtgtgttctacctgttaagtcttaatatcatttattcattctgggcctgatcaaattcttctcattcttcactttcatgtcactgcttttgggttgatttcctgaactcctctaggtaaggttagatggtaaatctatgtattcccatatcaatttgtacatcctttaaaatacttatcattttgttttaattacttgctatacgtctttcaggttccaaattcatattctttctggtgagaagggacattgaatggtgttgtccaggggtaagacacggaatatggtggagactgctcacctggaccatggataccttgtctagagggtactatggttattagcatgaacttattcttgatgtatgataatacaaacccagtgttgccaaactgcctaatttttcaagagaagctggaattcaggatttatacatgtaatttcctgatttttaagtgtacacacacacacacacacacacacacacacggtaaaggccaaacaaaatttctgtgggctgaatatatccctcgagctgaaagttttttgcctctgcactagaaaatggtttggagtaaaatttccattgttacaacaatgcaggcagatgatatttttggatcagatgcagtattttttgccaccaaatatgttaaatatccaacaagccatggctgagacattacaccaagtccatgctgataagaacttttcatttgtttgcttcatatgtgatctgtagattcatggcactaactactatttgtagatcacataactttggaatttgtaggggcctgagcagttattctcagagtctatgctggaactgccttttctctataacatcttggatagatcgcagtccatccgtaaatagtgcacacctaatatagcagaactcttaccttgtaaggtaatttagttaattatcaagcacttcacttatctaagaggttttcattatattaaacaaatccagtttccccgttaagtagtcttattgaccttttggaattctatagcaatatctaattcctcttctgttggatggtgctaattatctcaataaagctaccaaaaaaaaaaccaaaaaacttctgatcctaagtcttatgaactccctgtaaaacagcaatgattccttctcttattttcctttgtcatggtttccttcatctaccccaaactgattctggatgttagcaacagctcatgtgaaatgtgaatagaatgctctagggctttctggtcaacacaagatactcgtctcaaagacatagatggccacatagctgtagacgctgtaaatgcagcaaggttgaatttactgttcagcttcctcatcatgtggttgtcctacagtgagcttactatcaacttaggttcctcggctactttagtcatatttttctttagccatgttttcccatcctgaaacttcatagctggctttatggacttaggtgcagtaatgttcatttctatcatattattttattgtattagagatgatccattctccatttttagtgagttggaagaatagatcatctctactacaataaaattgagacgaatgattcatctcaattttaatttatttgttcattcattcattcattcattcattcaactatgtatcaagcacccatttatgtgccaagtactaaaagtacaatgatgaagatactcggagattaatgctaattattcaccttgtttactgctgcttcaaattttgtatcacctgtgaatgggatgagcacattaaggtgacaaaaatggccaactaagattatatgccagatatagaaagatgtttgagaatgtctcgatgtaatttactacattaacactttaaaaaggagaaaaaaattttataataaaaataaatgtagaaatggaatttgataaaatgattcatcttttctttgtgttaagataaaaaccctgtagattaatatggaaaataatttcttaacttgataaagaatatcttctgaaaagtgacagcaagcattataattaattgaatagacatagaagcattttttaaggttaagaataaggtatagatgcctatcattgtcacttttgtctaaaactatattggaagcttcaaccaacacaataacagtatgtaaagtaatcacaggtatgaggattgaaaagaaaaagacaaaaggtcattatttttaagcaatatgattgttcatatagaaagataatctacttataatcattacaactaataagagagattagtaatattgctgtatacaaaatcagagtattaaaaaagtttatatacatcatgaacaattagaaaatgtagtataaaaatacatattatctgtaatattagcaaaactatacatggcttaggaatacaatgtgcaatactttagggaaaaattataatgctttactaaaggtcatagaagaaaattcaagagagagacatgtgttcatggagagtaagatcaatagtgtaaagatgtcaattttaaagaacttgaaccctgtgggaaaagcactgcaggagaagtgtaagtattgggtgatggttgaggtcagccaagcacagcatcatggtatcaggaaatcagcaactgagacttcacatgctaagactgcatgacaaaatgagaagatagatggcccatgtttggtggtgaagggggtgaagttagtgtttataatacaattctatttccagtagaaaaattaaataactaaaaatagtctccgttatgtagactgtgtatatatgatgaaatgagaaaggctactactctgtggcccttctgtgtatagtccgtgtcctttttgaaatggatagaatactcagatgggggtagtaagggagagtttaaagaactatttataggactatcaacaggggtgggggatacctaaaatgatggtaaagcagctaggggctggcaataggtcggagtcactgtgatccctaggctgaagacgcacagggttaatggctgttaatggaaatcagagacatagttgtagctgtaggaggatcaagagatggcaattgttactttctgtagaggaacacagccactgctaaacaatggcccagcagagaggacttggtggaataaatatcacaacctcgctcctctcctaccctccatttatctgttggtgacctccattgaccaactcctactgaaagtcagagagaaaaaaaatcccattggtgtagtccataaaggtcgacatcccagagcacagagcagggcaaagaagagcaaataatggatttagaggggaaaagagagaatgttcagcgcacaagagtagctcttcaccaagcttatatgttacaagtctactcacactccattaactgatgagaatcaatgttgaggagtggatgatttttacactttccaatcaggactagaccagagcagagccttctaaagaagggtcttcagtgcctatttctaaactatgctggggaaagcaggatctgactggagaataagtcccttggtaaacaaatgtgagtatttgccttgttcagtccagcttatgctctgaacaactaaggatcttgtactatataccaatgtacccaggtaactccaattattaggagccagtgaattggatatatactttgtgctcattccattctccttcctactgctgagtcaatcaccggtgaaatggaactcactgcttggattgtcttcatttggatctcagttccgtcattaaacaaatatttattgagtgccttccatgtgcaagacactattcgggcacagtgggaatatcacaatgagtaagagagtccttgccctccagagcttccaggttggtaagaaaaagaaactaaattcatagaaacctacaatgaaaggctgaatttgttatcctactacccctgtttttttccccaaactgcttctctttatgggcagtgtggttgtcctccatcttgtttgtgttgatgtctcgattcttttttttttttttttttttttttttgagatggaatctcactctgtcacccaggctggagtggagtagtgagatcttggggcactgcaacctccacctcccaagtttaagcaattctcctgcctcagcctcctgagtagctgggattacagccacatgccaccatgcccggctactttttgtatttttagtagagacggggtttcaccatgttggccacaggctggtctcaaactcctgacctcaggtgatctgcccgccttggcctcccaaggtgctgggattacaggtgtgagccaccaccccaggccagatgtcttgattctttttgtcaaacctgtccttagaaatactatgattgtaggacttaggaggctgtaagcaaaatgtttaaataatagcatgttggtgtttactaggagacctcttccctaaacacatcatgcttttgctgggggtaggatgggactcagaatgtgggcttacttctttgtgtctctatattgagtagcttcatgccataagtgttattagcacaactagagaactatgcatatttataaagtgtgatcagtgttattctctacacattagcttgagggcacatggcatttaactcttgcaattccagactcatgcagtgacctgagtcagagtctgcaattttgtcttcagccctaccttgatagcaacagaatccacccaatcagaaaggaaatgaaaaggggaagagtgggtttttggtggggaggggtgcctttgcagtgagctctgctctgtctcaatctttcttacaggaggctaagcattagtagccccaagtcctatggatattgtgtgtagattctcttgtcttagaacccaatggctgcagcaaggtactcatagctacttctgttttccctagaattctctagccagttgtccaccaacccaaagactcaagtagaaaaagtcccaagtatttaagggctcatcccaacctaagaggtccacatgagcttcagaatatagcagattgggtctcacattcattgttttgttgttgtttttcggttttacataaacgtgagtgccagtatctttgggttgagactgggcctctaacaaggcccctgaattccagtctgctcttacatctgccctcttggtatagttcaagatccactcaaagtggtcctcagaacagccttcaacagattttggaagaaaataaaaggaggcccatggacagaaaacttagggagatggtgcataccctcttctcttctgaggaacaaaaatggtaatcatatattagaggctctgagaagtcttacaatcaccataaggaaagaaaaacccactttgattaaacccacattttacaaatgtatttgctcatacatttctcctctcctttagggaaaatcacaatatgttggattgtcaaactttcaataaatgtgagtggctgttggcaattggaggtctgcggagaactctaaagtttccaggaattggaactctaaaggctaccttccgggactctgccggctacagtcagtccccacatctttgagcttctgtggatacctgaccagcggtagcttcccagtgaatgccctttatgagccagcactgggcagggtattgcagtcagaaggcgtgagacaagcttgaggcagtgccttaaagggtggtttccatggatgccacccagacccagatcccagaggcacacacacaagcacttgcatctgttttttcactcggctggcttgcttcctcaggcccagagctagggtctggggattcccatctgggttctgccgttaatgggttgtgtgaccttggagcagttacttaacctcggggtcctgtttcctcagctgtaaaatgagggggttgcattgtgtggtcccaaagggaggcttccagttccgctactctgtgaattttgcaagcacaaaattgtgtgtcccctctccatgcctcaatgcttttgtcttgcaaacgaaatgagtgtgagcctcagaaaaagtggggtggcttatagaattgatgaatgcatggtggtttaagctggagttccagttcttgcctgcacttgcaccttgcatcctgaggctgacatctgcttattgtcaaacaactggaagacgcacacataagcaaaatcaaagatccaaaatgggaagctggccacagggaagctgggcccttaagcagtggttacaaaatgaagtatcaagaggtcgccaggaaaagtgaaagagaatggtctggtttgaatcctagcactagctgcttaacctcacttgatccgtttcttaatccttaactcctagctctctgggtcatcctaagggttcaatggggagcaaagctttggaatcagacaacttaggttgatggctttgctctgcaactcacttactgtgacctccagtgggggttgagtaactcttatctgaaatgcttgggaccagaagggtttcacatttcatatttttgtcaggttttagaatatctgcatgatattaatacttatgctccaatgagcatttcctttgagtatcatgttggagtttggagcattttggatttcagattattggatttgggatgctcaacttgtagtttgtttgctattgttggttgcagtcagttctcagtaaatattggctctctccatccatatttattatgttctgtccttttccagattcatatgatatgagacatcattgtccaatttcttccttacaacagtattattctttttttgctagatgcaaagggaagccttgacataaacaaacaaaacacaacctgattttttgagccatttgaaagtttcttttataaacaaactcatttcttgaatcatcttttgtcccatttaattagtatttatttgcctctgtgttttagtctcagtaggcaaaccaggaagtgggagctgaggtcaaggaactttcttcttgtggttctaagctcatggcacacagggctgagcctcctgggaagcagatggagaaactccagatcctggaaaggagagagggggatgcctgcatactcttctgccccagtgagcaggtgtgccccgcccctgtctctcagcaaagacctgccaagtaacaattgacacattgtgtggaaataaaagcagtgggcgagtagctgcagtttctaatggcagcgtgggtagtcgggggcgggccagccccagcagtgacagctgtggtacccaacattgtcagtgcagacgctgatggcctctgttccccatgcctgcccacatttgtgcaccctgtcactgcagggtgacaagcccaaacacagggagcctccctttcttatgctaatgctctgtaatgacagcttccccagcccaccaggtgtgacagccaccagaggcagcctccactcccactgctgagtttcccaccccgagtcctggacctgattcaggatggagcctggagaaggacagacaccctctgccagccatgaagatcccaggcccacaagttgctggccctctgtagcctagatcttgactctctcctgctcattagggcatcttgtcactgtccactgtcttcatcttcatccaccctactccttgctgtctaaccacaagcgtcttctttatgttcttacatgcactaaaaccttccttgttttctcttgctgttctttcttgcttggagacctttgacacttgctcttcccttccttgatttattcctgtccttcaggactctgctaatgctgccgcttctctggctttcttgttctatatcgatagccctgtgtttgttcttcaacatcactgtttatttcctagatactattgatattgatctcagtctttaatgttcttgtctgataatgtatttatttgcttatttgtctcttctactataatataaactcaataaaggcagggacctggtctgtcttgttcacagctccatccctagagtctattccccattgcctggaacatagtagctactcaatgaacacaagtggaatgaataaatgaataaaaatatgcatacaggaaaacgctcccataagtaactgtggctcatcaagcaatgatccccaaatggggagtcatgaccccaagggcacacactgtcttagaaaagctgcccagtgatcctagtgcttgctcttttgtaagagtaagtgaactctgctgcaaaggcctgttcctgtgcagccttctgcttcttttgctttcctaaattttatttgtctgatcctttagccatgttctatgccaactctggttacagctagttaaatgattaacatttgctctcccaagctagtccagcctgagggctatgggtaaaaatcatttaaaaatcttgttttctttctgaaaacttgtaaggatctctctttacctttgaagtttggaaatttcacaagatacctagggtgtatgtcttttttcattagttctgcctggggctcagtgaaccctttcaatctgaagaccaaaccagcctgtcctctaattcacagttttcttctattatttgattacttttctcccattcattttcctgtcttcttctgggtctcctagtaattacttaaatctcctgaattcatcctttaagtcccttattggctcacccttgaatctccttttaaaactttaattcttatgcatttatgcatttatgtttggactgatttgtaagatgtttcttctaattggtctttccatcactaactctcaggagtgactcttcactttttcaaattttctattaaatttttaaattttggaaacaattttcttccagaaagcctgtttcttgcctcagtcacatctctttgagagggaatgttacttttctatcaaagttgttttttgttgtttttgttttttgttttgttttttctgtttatcacaattttttggcctcaacaggagccatctgtccctatttgtcagcctggtcccctgtctcaagttactgagtctctttaaaatggatggaggtttctttgccttctcatgggtgtggatgcctccgcatccataaatgtggtaaggacactgaggctcttgttctggtgggtttgtgctctgtccttcttaaccccaattctggcctctctccctagtccactgtctcctccacagaatctcacatcctagatatgctcaggcttgtctctggatttcatactttggccagttcaattgttttgagtcacctaaataggaaatgtagaaagactgagcagccacctttccagaatgtccagtagcaatacaaaatgcagtgggtaggtggtttggttcttagcctaccccactgtgatcaccggggaccctcttccctatctatggcccctctgttttcctgaggatatggtggttacctcaggtgctccccttggtggtcaatgaatttctctagcttcagcttcattctcccatcctcatccctgcttcccctccccaaccccgcgtcgtcctgtcactgaagacactacctatgtctgctaatcagccatcatgcacatgttaaacctgccttgactgtcctggctcttcttgccacactgatgtatggattcctttgtatcctgcctcaaaacaaatcttcatttgttatgctctggcaatctggaacattgctcagagctggcagcctctgggtgctcgattcaaaagtagctcttcctgcaggcaatgaccagaggatccccagaactattttgatcaagttgatcaagttttatccttttctaggctgcttatttattctatcagttctcaaagtgtggtccagaccctttcaggagtctgtgcagtcaaaactaatttcttgaggagattagggtgttaattttcccgttctttctttcacaaacacgtagtggagtttccaaaagttatcccacatatcatgacatcattgttctggtggtgagtgggatgtgtaaatgaatattcttgggtttaaagcatttatcagttctaatttttaatatggtacatatcaatagctataattcacgtaaacgcaagctccttggagtattcaacactttttaaaagatgtttacatcttttaaacagtcctgaaactaaaaagctgaacaaatattgatgtattcatttactcaaaaaatattattgagtccctgctgtataccagacactatttttttgtggattatgaagaaacacaaagaatgagacagagcctttgcttttatggacattctagctggggaggtagacaactacaagttagtaattaaggatagtatctaatttcaggtggtgataagtaaatgaagaaaaaacaaagctgaggaaagagtgcaaatgccaagggttgcaattttagatgggggagtcagggaggcctctttgcagaaaccacactggatcagagacctgaatgatgcctaattctttgtatcatttctcccaggaggataagaggcccaaagtgcacatggactcatggttgcccattaggacatgaccgggctttctagtgggtgtgcaaaatttgtctctcatgaaagacattactactttaaatagatcaatccaaagttcagttcaaaatgtttatcacaatcatatgaatcatttatgaaatatttaatagctgatagttaccacgtgccagggattgtgaaaattatatcacatgcatttctcattgaatcctcataataacacactaagctaaggactattcatatctctactttgaagatggggaatcagaaggctaaagatgaagatgcaaaatccatcatcaaagcagttagcagcaaaaccaggtttcaaatccttgtttttctggttccaaaatttatgctcttgaccatgaggcaattgtgagaggcctgggaatctataaataaattcacattcctttctttgtagaagctcattgtattatggaaataataaatagacagtaaattattataccatgtggtaaattctgggatttagaaaggcatagactataacaagaaaccaaaagagggtcatttaacccaactggtgggaaagcacctatagaagcttctagaaagaggtgattcgaaatctgaatcctgagagttgtgaggacaatcaagggaaaaaagaagagaagtatgttcctggttaataaatgagcataaacaaagacactgatgtatgaatactatacagtatccagaaaactgggaagttcagtattgctggaacatgagaaatgggagaaccttcagcaagaggtcatggagttagaaggtttgtgattatagacagcattatgcaacatattaagaagcttggaatttgttttagaaaaaaataagaaatcattggaagtttttagacagtcaaatatcaaggtaaggattattttaagtaaaatgctctgataaccactctgaggatagatgtgaagaggaaagagcagtccagttaggagagaaatgtagtggtccagggatgagataatggtggtttcctctgaggtaaagaagatgaggatggaggagaggagggaggttgaggggtcatgtggaaaagtcagcagggtgaggtgactgattgaagttgagattcagtgaaagggaaaatgagggtgattcccagattttggctcaaatgactagattgactagataaatattggttccattggctgatttcaagaacaaaggaggagcagcatgagaggggaggttggcagaatgtgacatgatggtgcacgtgcagtgcatttgaggcaccagttgcttgttttaggaatctgcagctcaccacagagatctggagattgggatctggacattctcaggaactcagtgaatgttaaaatagtaggaatggatgagatcatccaggagcaggtggtagaacagtggtgaggaaacaaaacagaatagcaacagcataatctttaagaatatttaggctctgtaaccaaagttttaccaaaccagttacagaaactctagctaacaaggtctttttatctggtggggctaggaagaaaatggtgtaggaaagattgctatgaatgaaagaaaggaagcaagtgggcaaatactacagtgaaagcccatggaagagggagaagagccataggccagggaagatctatggagaagagacgaccaggaagtggataggtcagggaggggttaggttgttggtccttccaaaatttatgctctttatatgtttaacacagactaccttctccattcaaatcatgtcagaccaagtatccaataaagacaagattgaggtccatactacactgggcttccctcttgctcttatctgaaggtcaatcttaccaatccctctgtgccataatccagtaacctaggccatcaggttatagatctcctggaaaatctaaatcaaatgacaaggagaaaagttagctttccaactcacatggtcctgttgctttctggttccctgggaagctacatggacaaagatgtctgtagggctgaatttagttgtcttttcttcttacattgaaaatttcatttaggcttctgaaagctgtggaattcatagtcttctatggagacggcctcttttttggtggtgtaattggagtcaagtacttatttgttgcttgcaaacttttagtagcgaaaataacattaatatgacgggtaagacaggagttttactgagagatcaatgacaagaactggctccagaaagacaaataatcttcatttcacatggcaacctaatgataggtgaggacagatggtgacaaccctcaacctggaattcttcttgaatcaatcaatcaatcaatcaatcaatcagcaactatttattgatctgctgttttggctaaaaacacagaccttggaagcagaagcctgaattcaaaacccaagttttccatgtacccgtggcttatttttgggagagctcccgaacccgtctgagcctcaatttctttctctgaatagtaaggaaaataattgtagttaacccaatgggttcttgtggggaccagttgaaatgtaaggacccagtaactgtcagctgctattattgttgtttttgatattattgttgtggtagttgttgccgtgattgttacaacttctgagtgctctgggctactgtataggctttcttttttccaggcggattttatgatgttccctggaaatgtgccatgggggcttcaaagaaatttccaaggtggccctgggcttcctggatacttagcgtttatagttttccgaccactcagagaaacacatgggtctcagcccgtgaggatcccatggggagaaaagggaaggaaaggaccatgggggtaagagggaggtgaagagaggacacaggccgtcaggagagagagagaaagagatggggcatggggagggaaaaactttgtggtgataaaagaagaaacccccacgcttgtaatcccagcactttgggaggctgagggggcggatcacgaggtcaggagttcaagaccatcctggctaacacggtgaaaacccatctctgcaaaaaattagctgggcgtggtggcacacacctgtagttccacctactcaggaggctgaggcaggagaataccttgaatctgggaggtggaagttgcggtgagccaagatcacaccactgcactccagcctgggtgacagagcaagtctccgtctcaaaaaaaaaaaaagaaaccacaagtttttgccatcattccttcaataaattaatatctctagagtgcctattctgttccagatactcttctaggtgctgaggataccacagtgagtaagagatatgaagtccatatcttcacgaatattacattctgtgtgggatggaagggagcagacattaatacatcaaataatttcagataacaggaaatactttaaagaagattaaactgcgtgagttgctagagattagcttagggaggatgagaggacctacttcaagtcatgtgttcaggaaggacctttttaattactaaagagagattcgccttgtttgggggcaccaggttttacccagtactgaagtctcattccatgtggtggatctaactggcctgttctcttccctttcactaccttttcacaagctcctctcctcctcatgggcgacagacagcctttcttattaatgaatttgggaacaggacctaggtattcatagctcagcctatttcctctcctttttagggcagagtgaagtgtttgcaaataacatgtagtcttctatgcttcttcatgctttaggtttaccagggcagaactgcttgttgggggcagctgcagtggtttggcacattcttttctggggttcaggattatataccagcctttatgatctaaggcagtggttcttaaaatgtggtccatgaatcagcagcatcaacatcatctgggcacccattagaaatacaaatatcaggccccatcccagactttctgaatcaggtgttctgggggtggggtccagcaattcttgttttaaccattgcttcagttggttcttacgtgcactcaagtttgaaaccactgcttaagtgcagttttactttctctaaaatgcggtgttccaggtgttgaaaagctttgccattccaatctgcttgaagtcagtggcaaagagcctaaaacttgaatgtcaaaagcttttgcagttcttttgtgtatctcagggtacctcgtcagcctcagcactaatgacatttggggttggttaattcttgttttagggggccgcgggggtgttgatcttggacgttgtagggtgtttagcagcatccctggcctttactcattagatgctagtaacgttccttcctaactccagctgtgacaatcaaaatgtctccatgcattactaaatattcccttgaacacaagatcatccctggttgaggaccattgatctatctgcattagttgagagtatagcttgtggtttgttctccaaaaccactaagtcaaatgtcctgcttaaagaaataataatacccacatcatagattgttgagatgattaaatgtaaacatctaaaaaactgttagaacagtatgtgtcttataaaaatggtcacataaattaggtattagtaattcttattgtaattaaataatatatagactatcaaagatctatttaagattagttgttagtatcattattacttgaattattattatttctccttatctcctgaaatgcctatgcagaagttaattgttgttgttaattttacttctttatctcatgaaagacctgaaattgcctttattttgaatatggcacttctagatcttttatctattaagagaaaggatcacaaagacctttgttcttattggttttgccttttacccacttatgcctttcagttagaaaaatgtagcaaacatgtgactaaaccactcatctgtttcccccactctccttgaggaatgctcaaacacatttggatagtctgttttctcagccctcggagtcttgtcacttactccgcccacttttaaaaagaaaagcaggttcattccttacccccacccctatcccatgaacactgtgatcctcatatgtatgtagagactcttttaaaataaatttttcatagtgtgccaggattgacagctgctgcccacgtccttaatgctgtaacagcaaacatctgaacaaagaggggaaaagtcagtaaaccatctggatgtttcgttgatgttttgccatgcaatagaagttatgcaacatctggatgacaacctagtactttgcctttctattgggctgcttgggtattgagtagacacagattttattgtaacatggtcataatgtacaagttcagaatttcaaattcaacccaaatcttttggagcctgaattcattcacccttggcaaaacgtgagtatgtatttttaaagcaataagacttggaaagtttattaaaatgtctcaaaaggcatttggacgtcaaataactctcaaacccaatgtttttgcgattcaaatgaatcagaaacatatggattaaatttcctttaaattgctctcaagattaaaaatcaagggaaaaagtgcccagggccaaatatgttttgggttttgcaggacaaagtatggttgaaactgagctgaagatatgaatagcacccatactgtctttttgaaggaccagagttttattcacagagcatttattctcactctgccgagcaaccacacagaccaccaaacacaaccataataacaaacatcaacagttaaaatgtctgctaatttgcagttagccaaaaacaaaaaacatacttcaaagtcaaactaaagacgtctctttctaaagttcccctgcaggatctgaaaatgattaaaaaagaaattatgtctgaaaaaggagctgtttcaagcattatttaaaagtgggcagagatgggccttctaacagccaagacacctcaagcagcaaccagctctggactagtcattcttggactcagataccaatttaaattcagcgccaaggggtctaaactaagccagaggaaaccaatctggaagacatgatatggatgagcatggaagcttagttctccataggagggttctttatttgatttctgctattcctactattctctactcttgccaatgaaagaacagaatcagaccttattggtgaccaaaatacgtcttaaaacataaaacacatgttttaatctgattgtctcatatcaacttttttggtcaaattatttgaccttccgtttctgcttcttcagattaaaataatagatctcttttcctaagtttaccattcttgactttgaccagcccctgaaggcaaagaaatatttggaagaaagagtaagagcacagtctgaccttgcttgctttatctagttggctctcctgcagaaattttccacaccacctcccctgtacctcctgttccccccttcccggtattaatttcatggcttacatttaggaattttattatagttaggggttgtatttattatccccttttatcaagtttcacatcagatctctgaaactgttatacatttcagaaagccatttatttgttcaacaaatatttattaagctcatactatgtgccaggtacatatttactgaagatatatctgtaaacaggataattcagagtagatgagtacataaatggataaataagataattggagatagtgaaaagggttatggagaatataaagcatgttgatgtgatgagaatatcagtgagtgcctgcatatcaggagggagggagagagaaagagagagagagaaagagaaagagagaatagatataccagggagactgggagggaacttaatggcatgatcagaagaggctctctgagtaggtaatatttgatttaagccctgtatggggagaagcagctttgtgaaaagctgggaaagaatgctcctggtggaggggacagcaagagcaaagaccttgaggcaggaactcacttggcccattgaagcagaatgaggactgtgtgcctggagtttctggtatgagtgagagatattatcatgtgaaattagaaaggtaagcagattacatagctgcctgtaagccacaggagggttgtgcattttattgtgagacggggaagttttcagcctaggccagcatgatctcttggactcatatttttaaaatatcattttgactcctatttgttgactggactgtagggagcaagagtttataacaaagaagactggctgatcaatgtatgccccatcctcagtctctacttttgctgagacattttgaacaccagtgattcccttttttcccctctacccacaggtgagaaattgagttctgttgcccagcatctgaaggggtgtaagctcattccctacccttcctcagatactgggcattgggataatggtattttaatgactttttcatgattgttaagacttggtgttatatagacaagcctcaaaacacactactagttgaactcatggtatgctccaaacacaataaaacaatccaaaaatcttgtcagagttgaattttagtctgctgaggtacttctcaatctttgaaatggatataacaattgaatttataagattattgtaagcattgaagtcaacgcagagtggcaagcacttaacacagtgcttgaaacataataaaagacttcttgatatgtattggctactattgttacctccaagatattaaaataatctttgaaataacctagccatgacaaaggtatcacaaatagagactgtagtgtgtgggccaatatcatttgtgactattgctacaactatctttaatatgactcaatagaattgtgtattaaaagtgtaatattccattaccaaatatggtttgtttggaaggcaagggcaacattaatattagaaatgctataaatacagcacattacagctcccagattctttttctaacaatgccaatcttgggttacctgtaaacatctcaccatctcacccctagagtatgtatgggaggcattacaattattcccctaaaggattaataactacttcagattagagttcacagcttttaataacattaagaggataaaaatactcctatatacccctaaaaataagaagaacatttaacacgatttttagggttaacagttgttctttcttggtggtaggatcacgtggtatacctcaaatcaattgcagtgtacatctattacttctgtaatcagaaaaatgttgcaattgtaatctcaatattagattcccagctgctgtaacaaattgccacaatcttggcagtataaaacaacagacatttctcctctcacagttctggaggctagaagcctgaagccaaggttttagcaggtccgtgcttcctctggaggcttggggaaataatccatccttgcctcttctagcttgctgtggctgtcggctttctttggcttgcggctgcatcacttcaatccctgcctctgtcgtcttatcactgtctcctccttatctgtctaatctccctgtgcctgtctcttataaagatacttgtgatggcagttggcacccaccaagataatccaggataatcctcttatctcaaaagccttgatttaatcacacctgcaaaaactttagcataaaggataacatataggttccaaggattaggatatggacatatttctggcaaccattatcagcctgccatagtcttgtaacaaaacataaaacacacacacatatatatatatctatatatatgtgaatattatttaaatataattttttaaaaattgctgagccaaagccaatggaatgtttaatagtgacattcctatttacttggggcaataatacaaaaatgaggttcaaagtatttattttatttgacatattctggacaaggagatgagataggaaatagactattgaattaaaggaagtaaatgatggtggtttttggaaaacactattttctataaaaaaaaaactgaaaaagtattagtatttaatgtaaaaatgaccagataaaacattagtttaagaaagccaatgactgtcgtatatgtcttgaaaaactagctattatttaatataacaataaaagacattctaataataagagcagcatcaacatccacaaacaatacccgtcaaaatatgttaatttggcactttagcgatattctctttttatcacagtaatagcatgcccatagtcattgggagaaactagaataaacttgtaggaagacagagtcaccagactggtcacccgtatttacctgtccctctgtggtagttttttttagaggaagggtctgcattaaggactaagtggaaagtcagtccttattttagttagacttgtgagtgagctgaatgagactgattcaaggcagctgataaaagttaattgattgattgacgtattttcctttaaggtgtgaatggctaatagaacaggcaaatagcttaagtgtccttctcctcttccaaccctaagaattatatattttcctcaaacaaaccctcaactggtaatatttaaccagcatgggtaacttttagggggtggaggaggctttttgttaagaaaacatcaacatcattgcttgttatcttgtgttcttcaatgagcagagctgacccagcctcctcttcctcctctcatataagaaagtaactctattctatcttagcctccagctttttggaggttcttccttaagagcctttttagcaaatcttctcagggtctgcctccatttcgtttatttccagacttgctcatatttttcttttagtgattcagcagggaatggcatcaagaaggagcctgttctcaatttgtttcttttccttatgacctaggattgactgtcacatgtaaattaccaggcctgtgaaagccattcaaggtgacatgcagtgatcttggaccacagggcatcatcagccctcagtatttaacagaaaaaaaactgatgagcagccagtgaaggtcactgggcttgaggagcacataaccctcaccatattctttacttttaatttttcttttatttgatttactaatataacatttatatacagtgaaatatatagattttaagtgtacaattcgctaagtatcaatgaatatatgatatacatatgtatttatgtatacacccatgtgactaccactctgatcaaaataaagaacatttccatcaccccaaaagttctgtcagcccctttcagtcagtttctaccttcactccacccaataggctatcactgttcgattgctatcattatagatcaattggcctgttcttgaccttcatgaaaatggagttatatggtaggtaatttttatatccgcctcctttattaaaaggaatgtttttgagagtcatccattctctctaaattttgtgtttgttcaacatttaacaacatggcaaggaggaatatgaaaggtaaatgaagaacaaaatcctaagctctttggaaagacaagccatcgtaaacaaatttggtaaacatccatatgaagatttagaaacacttggttacacttggttaatggtgtggaggattttcattgtcatctccatgaatcagaacttgtggaggtagtggtaacatcagtctgccatcacatgacctgtaatgctgtggccatgggcatattttaaaagctccacttctaagtaacatagttcagttgagaaccactgccctgtaatgaatgtgagatgggcaatatgaatttattgttcttttagcaggttgcaattcctgcctgcttcttttactatgagaatcttgctgtgattttagtatttataaatcatatattcatgcaccatacttttaaaatgcaagttgacaattccatttatttcctttatgaagaaacagtgatctgttttcagtgctggaggaaaaatgggctgtgctggtcactccactgaggaaaattcctgaaggcatgctaaaggtaattttatctttatatgattttcactactttagacagaataggagaaactatgctgtcataacaaattaattttaaaattaataaagatgcattttttgtttaggttacatgtccaatatagattcacaaagcactcagattcccagtctgttcgtttgcagtatgtggattgactggactctaatgtcaccacagaaaggcacagaaggcagaatattttcaagggccaggcccaggaatggtttacatcagctctcaagctctgctgtaccttagaatcatcaggggagcttttaacaatgttagtgccctggctgtactccataccaattaaatgagagtttctggggctgagacgatacatcactgtgttttaaactctcctaggtgattcctatgtgtagctagcttgaagaaccattggcttgtatcacctctgtccttgcttctttggctggactgagtcacatgaccctgacctacactaagggagcctgggaaatgtagtcttcatgggtgcccaggaagaggccattgaaagagaagttggcaaacctatgtctttgtgtctcacacactcattttttaatgttaacttcagaatgtacctccctcaaacatacgcatgtcctcccactctaacaatataagcctcactatggaatggggaggagatgtggattgtcttgacatctcagagatacttgctgttcactctggtcccactcacatttgaagcagggtcctcaataaaggattctaatctttattctaagaacattgggcaccttttaacaaagggaccagtgaaactagatttaattgtttgatcgatgatgtggggcaagtgtggatgggagcaggccagtaacgaggtctgtgaggtcatccaggataagacaatggtggcttgctttcaagtgacacaaatggagatgtatttgagactgaaaaaatgagattatagacctcactacaagaattgcattagttgagcaatgcaggtgagaggtatccatcaggacttatgtgtttccagcacaatcagccagatacagactggtggagtgatggggaagacacttaatccaagtgtaaacaaaagtaaagtgaagaaatggagacaatgcagatagatactgctttgaagaaacatgcctcagaatgatggggtagcgggagaactgagggaattgccttgtccagccatcagtatcatgatatttacttcccacttaactattgatctgcatatatagcttcttgggctaccactcagagagggaaggtggattttaatgttaggcaccaatgtctctccttatacttggcttatgcctcctggccgatccacccttctgtgtgcctgcctgcttggtttaaaatccatatcatatcaaacagccagttaaggaataaaaagtttagaatactcaatagaagagagattaggaaccacactgtactttttttcttttaagttcttttttttattattatactttaagttttagggtacatgtgcacaatgtgcaggttagttacatatgtatacatgtgccatgctggtgcgctgcacccactaactcgtcatctagcattaggtatatctcccagtgctatccctcccccctccccccaccccacaacagtccccagagtgtgatgttccccttcctgtgtccatgtgttctcattgttcagttcccacctatgagtgagaatatgcggtgtttggttttttgttcttgtgatagtttactgagaatgatgatttccaatttcatccatgtccctacaaaggatgtgaactcatcattttttatggctgcatagtattccatggtgtatatgtgccacattttcttaatccagtctatcattgttggacatttgggctggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccttaaggaattgccacaccgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgaataggttgcgaaaattttctcccattctgtaggttgcctgttcactctgatggtagtttcttttgctgtgcagaagctctttagtttaattagatcccatttgtcaattttgtcttttgttgccattgcttttggtgttttagacatgaagtcctttcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctacatgatcgtatatctagaaaaccccattgtctcagcccaaaatctccttaagctgataagcaacttcagctaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatcactttcttcacagaattggaaaatagtactttaaagttcacatggaaccaaaaaagagcccgcatcgccaagtcaatcctaaaccaaaagaacaaagctggaggcatcacgctacctgacttcaaactatactacaaggctaccgtaaccaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgcttggaaaactggctagccatatgtagaaagctgaaactggatcccttccttacacactgtacttttgactgtgttggcttactcctggctaaagtgttgtggctcaggaaaattcccttgggaatccttgctttccattatggtttaagaaaatgttgtcatatttgagtcaaaatgttgaatagaaatttggaaatattgacccagggaatggcctacttgtttatttacgcttcccccacaacacatataccttaccccccgccaaccactagattaaaaaggcagcaagtctttcttctcaagtctttccagatagtctggtatacagttggttgttcaagggttatttttgatgaattaatgaatgctttgtggcctgaatcaaagaaactttgaacactctctccctgctatactttttgctcaggggctcttgaatggcctgtggataagtcgatgcagtggtgtcctcacagtggctctgtccatacccagtctcccaaaagacaatttttctctactctaacagttttttttaagagttgagatataattcacataccacaaaattcaaccttttaaagtacacaatctagtggttttagtatattcacaaggatgtgcaaccatctaattccactaatccccaaatattttcataaacctaagaagagctccaaattcattatcagtccctcctgattcccactaatctactttctgtgtctatcagtttgcctctcctgaaaacttaatgtaaatggaataataccatatgtggtcttttgtgtttggtttctttcacttagcataatgttttcaaggttcatccatagcatgtataatagtactttatttctttttatggctgaatataatatgttctgctgggcggctataccacatttttgtttattcattcatgagttgatggacctttgggttatttttacattttggttattatgaataattctgcactggctaataggtttagactagttagagtgaacaagtgatcctcagtttatcaaaggctcacaggacagctggggtcaccaatcagtggtgtcttatacccaccagtgagtcacctttccttttgatttattttataaacttacagatgtgctgcttctaggtagaaaggactatcagtgcaacaaaatctcacttaaaatacggtgaacttttatttttaatcaactcattgctaaaggaaaactagaacaaatccaatcagactgcatctcattttgtggacagctgcaataaaaatttctggatttccgggtttccctcagcagggacaggtgggtaggaatctgcccaactccagtgggaggatttgttctttttttagcaggatacaggaagagggaagagaaaaattgttgattgcacaaacgactaaaatggcacttcaattcccccattccatctagtttctggtttcaactgactccccaagtcatttcggtaatacaaaaagttctgcattctatgccgattcattttcagatggatctctcttgaacccaaattattaatgtttaggtcttcccaatgctggacacaccttcccctttgccagcccaagttagtacctcatctctttccttccctcctctgaaaaatatgaaaaggtttgtttcttcagcccgtgtggcattctatgaggcttgatctcaatcattccatcttttctcttcttgaggctgctgcctctgcacagacccagaaggcaggccctattagccatgcacagagactggtgggtgggtatcagtttggagccaagttcctgggcatgcatcacttttgcacattccttgtctgagggtgcaaaattgcacaagcaaactgagctgcccacaactggctaattgcagaggcaatcatcgccccggctccttccaaatgagcagggagcagctaattgtgctcacaattggctgattgagctcacagtcagtaaattgctgctgcaactgtttgtgcatacaattttgcacctgggagtaatcgtgggcgatagggtctaacacactttgaaagaacattaaacagtacaacatctgagaaatctaacactgtccagcctgcttggggaatttgagctgggtaggggaggcatacttcttaaattggagttggggtatctcagaccctgaagtaatgccccagggtgcatgttataactcatagcgctagtcataccacatcatatatctcttacctcacacatgaagctcaccggtcaacctgcaaaacatctcagccacaggagaggtggtagagtatttaccacatgagctctgaactcaggctaccttggttcagatttgagttcttctgtttccttgctgggtaacctttgcaagccttgattttttctcatatgtaagatgatgatgatgaaaaaatgtacctgagtcacagcgttgctgtgtagaaatgagataatgcttgtaaagaatgagcacatagtatttactcaatgaatgtttctaatttttaaaaaaactcttaggtcaaaatttgatcatgactttgacatccaatggagtacctcacactctaattttaggattattgttaatacgctggtgttagcatcaaagaaatttttgttttctctgtaccagctatgtgactgtggccaatttgctttaacttgtctaaatcacagtttagcaatctgtaaaatgggggtagaaatgttatctacccctctagggctgttatgtagattaaataagacaacgtatgtgaaggagttagcacttaataagcactctgtaaatgctagctcttgctgttgtcactactactattattgttataaaggctcctgtgagtggggtgggaccgggcctggagtactggggactttggagccagaatactattatgtaactcatgtccacagtgtgatttgctcctacccactgccctgatagaatggattcttttagatagaacagaggtgtgtgagctttatagcaaattgtcttgcttgggcccttcccaaatctacatgaggggagacattcagccctgtggccctgttccctgtgcttgccttgtcctggttcatttcttggtctctgatagagacaattttatagggttcttactctcagcaagaaaaaagagataaggacaagctttggcaggatccggaaattaatccaggggaggcagacattgtgtctctaaatgtaattgaatcttcctggagtctgatgggggtgggggatggagcatggaccttctgacttttaagtctgtgaggaggtgtggaggagggagggctgctctcccttcaagtccttctttcccatggtcccaacctccttcccttttccctttatgaccaccaccacgtgttctgtccctttgggtgtttctggctcttgcctcagcagcaatgcagggtgcacactccccattccttgctgtctaagaatccgagcatacaggactcttcacagtaaatgggctttactgcgatccggatgcagacagggacaaatggcaaagattttagaatcccagagttctcaccagcattagtctttgctcccaactctcatagcatggttagcttgggctgccataacaaaataccacatattgggtggcttaaacaacagaaatgtccttctcacagttctggagggtagaagcccaaggtcaagggattgtgaagtttggtttctcctgaggcctctctccctgtcttgcagatggccaccttttcactgagttctcacatggtcttttctccgtgtgcatgcatccttggtttctctctatccacttttcctcttcttataaggacaccagtcatgttggattagggcccaccctaaagtcctccttttaacttcatcatctctataaagaccttatcttggaatacagttaccttgtgagatactaggggttaggacttcaacgtatgactttttttgcagggggacacaattcagtgcataacacatgggattcttagaattttcaagaaatattttctctttaggaatgtaacttaatgaacccagaacccagctcaatcattaattagttgtgtgaccttaggcaagacaggcacatgtctcgatttgcctgggagtgtcccatttacctctgttgtcccagtgtagttacaagagcaccccctttcattcttaaatgtatcctcgtttaaataatgaatcgtgtggtcactattcattaactttagctgtcaaaatgaagtgaatgacacctaattcacaaaggtgctcagggtttgcaggggatgatggagaagtacctatcacactacccaatgcttggtaagtatgaatgtctttatactactttcttttttttcataaataatatatttgcagcatttatgattcacaacccttctgacaccagacctgtatgtgttttctacatcaataactagttcttcaactttctggacaccaactgagtgccctacaattcaattcagatctgacactaactacttggagttgcccagatcccacagggtaaaggctcagtcccacaagactgacccccacttcagctgccagtcctgcaacacagtcctacctcccacctgtacttcttaccaactggtataaattatgagttctcatgacccccttcctcagttttaataatttgctagaatggtatcttctaagaataactaattcttcaagaccttatagaattgttgtccaaaaggaagctcaccatttctattagttatctggcgatgggctcatgagtctgaaatttaaggaaaacagtttacttactgaaatttcaggaaaataatttatttgctaatgctggtattagtaagtattagcccaggaacagtcaaatggaagggatgcacaggaaaagctatgaaggtggagcttggagcttccatgtcccctccaggtgcaccatcctcccaacatctcaatgtgttcaccagcttggaagcttagtcatttaaggttttttatggaggcttcatacataggaatgtttaagtcattggccattgatgcttaactcagtctccagcttctctcccctccgcagaagactagggtaaggctgaaagttccaaccatctaattacatggttggtccttccagcaaccaactcccatcctaaagctatgtagaggcccactgagactcaccttattagcagaaagtcaggcacgattgaaagaggcttgtttcaaatagcaaaggacagtcctgttacggctgtcactcaggaagttccaaggttttgtttttgttttgagaagctctgcatcagggacctgggacaaataccaaatacatatttcttattataatctctcccttgtacttacacctttctattcctcaatcccaattcccttggtcaggcaggttcatttttcatgaggaaccgtctgttgagacacggcctagagatgatgacagtgtagactggttagcctggatcagtggtcatacaggctcacctgtgccacagtaaactggcattttaagggcctccagattcagtgagagcccaggtaatggccctcttccatcctagaaaattgttcgtgtccaccatcaatagctggtggtgcacttggatgaattagggctccttggctgcaagtaacagaaataagcctctggattaagtgaaatgaaacagggaaagaccctaattataaaggtagtttatggacttaaaggaaaaatgaagtcaccaagcctcaaaaaggaaagggactagaatgcttcctgtgatctttggttcagggatatatgtaagctcttacttttttaaggggagaaatcaaaaaacaatatacaaagagaaataataaactaaacatcaattttccctccatccagaatcaatagcagttatcattcattttgatgtgtttgtttctggaggagtttgttttttgatcttgttttgctgaatgaatgaaatgaaaccaacttaacttctcagtctccagtcccacttgcctcccctcagtctggagatgaatgttactgtgagtttgtgcaccctttcaggttcagaatcaagagattctgaactttgcttgttcaggctcttgtcccatactctagggacagtttttagaataatttcaggtacctcctaagaataactaattatttaagacctcatagaactgtttctaaaaaataaactcaccatctctattagagttattgggaggtgagcacaggaatatgaaatttaattagttcactgggtcattattcaacacactcaagtttgaaaaccaatgctttagagtggtttctaatttacgtgcatctctgtaaccaatatggtggggcattctctgtcttaggccttctgttagcatggctcatccccaaccagtcccatatctgggggagtgtctgatgtacatgggttgtgccacaggcctgctttcagggccccattatgattttaatggaccttggacaatttcgcctttgtaggcccctttttcccacaatagataaggaaaattatgttttatgattgggttggtataaagttgtatttaattcaggctggattatattcattttttccttctggttttcaaataaatcaaaacactcctgctgggccctaaaagtattgtgggcccaagccccaggcatggtgtgcttaatggagcacactcctgcagtcattcaaggaagaggcaaggcccatgattggcattctcagtcaaatcacacgaagggctgcttttctgatatagtaacacccaacagatgaaatcaggagatttcctcttcaagccctttacatttccattgtggccagagtctcagatctgggtgcagacacaaccctgctacactacaggcctgtcctttgaaattcctccacatccattcctcaagcagtctccagtctgggtcaagctcctggagaggctcatcttcccacctgaactctcaaacatccttggtcacataggattgattaagaattcattcctggagctcctgctgcagaatttcctcctccctgttcacctctgtgcatctctttacttccttgtttaagaaacaagggcaggccgggcatggtggctcatgcttgtaatcccagcacttcgggaggctgaggcaggtgtatcacctgaggtcaggagttcgagaccagcctggccaacatagtgaagccctgtctctactaaaagtacaaaaaattagctgggcgtggtggcacccgcctgtaatcccagctactcgggaggctgaggcgggagaatcgcttgaacctaggaagtggaggttgtagtgagccgagattgcaccattgcactcaagcttgggcaacaagagcaaaacaccataaaaaaaaaaaaaaaaaaaaaaaaaaaaaaagagaagaaacaagggaacaagggctgctgtgtgctgatttctaggcactctgttagttttcttagagctcagagatggatgaggtcatgcctataccctgaaagatatcatggtctcaagcagaaacaggtaatctgatgatgtacgtcatgcacccggcgaagtatgatgagtactggagatctgggagcagctgggggccatccttggttcttgtcacaaggaataagttctctacccttctgctcctctagctagtcctgcctcaactcatttgcaggaggccatttccctgggtctcagcctgtatcacttgacttcttgttcatcaagcaataaatcatatctcatcaattatatgatgcacatattttaaaagccatttaacatttctgtaaatgggttatgattgattgcctcttacaagcactgttggccaggtggcagttgtgacaaaggtgcattgcctgaacatgcatgagtttgatctgaaaagtattgatgcttctgataagatcaggaggatgtctgcaagtaacttgcagagtggggatcagcaacctggaaggacaccccagagactgcagctcgtaaccagtaatattgcatataattttttatgtatgccaaaagtgatagacataaatctaaaagagctttttaataattagaaaataaaatttccaaggcataaggaaatactgtgtcatgatttaatttgtagcatttttttccttaatagtgcttaaaataatgatgtctttaatcaatggtgacacagatttgagaaagtaggctgtatgtacaagtctcacggtggctccatggggacagagaccaccatattttcaacacatagcatagtgctggcatgaaatagatgcttaatatgtatgtgctgattgtctggcattcttagttaaaataacatgtacacagaataaggggaaaaataacaatatgccatgaatagacttagaacattttcctatttctcactgtgtgccttaagtgtacatatcatatgacataacattttctttatagctgggattggcaatattttttctgtaaagggccagatagtaaagattgtaggatctgtgggccatacagtctccgctgccactactcaactctgctgttttagcacaaaagcagccacagacacattatgctaactaatgggtgtggctttattttaataatactttatttacaaaaacaggcacatggcaggatttagtcaatgtgccatagcatgtcaactgctctgaagcatttgttttcaaatttgagtgtgtataataatgactcagtgaacttgttaaaattcagattcctgagcccatctccagataactttaatagatacagtgagcttctttctttttgagcaacacatctataaggtcttgaagaattagttattcttaaaaggtttctgcaattcttctagaaactttctctagagtatgaggcaagagcctggacaagcaaagtacggaattttttaatgtcttatcaagatatcaagattttttttccccttttatttgtatggtgatgtcatttccctttttctttgtatggtgtcaggaggcagccacatattattagggattaaataggagagctagagcatttttttttttaagaagacagatgtctcatcacccatccagggtaaaggacaagtgttcaaaaatgaaattataccccttcaattttatggtcaaaaggagattcctctctctaatggacaacagaagtcccagtagccatgactgagtgcaggctgggattgtgcccataggagaaaccactccagaccaagccttgtctaccaatacagaggctgatgtggttgccacatgtgcagagctgtgcagacccacctcaggtaaacattggattcaaagaaactataaggcatcgctgcaataagcctattagtatggctctctccatggggtgattttcttcttttttagagaatgaagtcctcttagatttgtttgtttgtttaagagacaagtaaatagttttgaaatctctgcgtgagattttaatctggttaattgtctttaaatacctcttgcctgggtatataaacctctttagtactgtatgtggtcaggatgatgcagagagtgagaaattatgtgataatatagtaatgataacatttatctggtgggcacggggctaagaccttgaatacattgactcattctgttctgacagcaactctcaaggtaggttctataattaccctcatttttgcagaggaggatgagaggctctgaatttaggtagctactcaatgtcactagctagtagacattagagccatgatttaagtccaggcattatgactctttatgttgaactctttacctttacttaatgagacatcttactgggatagcacagcaagggtgtccaagaggagaaaaacagaattctcaatattgtgttgactaaaattcgtgatccatgttggataaaacttccaccagcacctcacaccaaactgacatctactccgttggaagatcccaatgggagttgcacaagttatttttttggaaagtcggcagtatggactgaaggtggaaatagggttaggcaagactgatactagagatactagactccagttccagaaatgggacatagggtggtcttgtgagctgagactttgtaagggcagcccccatcctgaaaaagatctgcagtcaggatgggcactgtgtatagccctgggagtgcatcgtacttcacaggaatgtcctcttgcccacatgtacacttccattgctgctgtcttcctccatcatagttgcctggtaaaactccaaccctggttaaatctaatggtctactttctctgaaccagcacccaagcttgttgaaggaaaacacaaccatgttgacaggcgatgcactgtatgattccatttataggacagcctggtcaaggcaaagttaggggacaaaaacagattagtggtttccaggggcagggagtagggctgtctataaaaggcatgagggaatcttggtgggtaatggagctgttctgtgtcttcattatggcagtactggttacatgactgtctgtcaaattacatacattaaaaaaggtggatattactgtatttaagttatatcttactaaacttagctaaaatgaagtctcaagaagcagctgggatacaagatgaagaatcatatcctgagctataagaagaagatgttatcatctttaatattaaagaaaatataatttatattaaaaagaatcttatatggtaaattattgtcctaaagtaaattaactgattgtttaaagaaagggatgtttactacaagtcagaaagttgaggcatgtcaaagattgtctgtgaaagttgtgaaaaatgttataaaagggaacttaggcaagaaatattgtgtaatttaaaagtaattaggcctcctggatgctttataaaatgtcactataactcttagctgtacgacttgcctgccttgcagctaggaacaacctagtatacgtggagttaactgctggaacaagccagaccttatctgcacttctgtctaagtcctagactctacacctagcacataattaaaatcccaaacttaccaaggttttcaacaaaggtaaaggctgctaaaagttaacagaataacatgtatttaaaactattgaagagacagtttatgtgcaaggtgtgtaagaaaagtaaaatatacttttggtaaaaagattataaggaggcatgagaatgtggatttttacctagattaaaagcctaaagaattgttttgaaggtttaagcaagttttaaaaggttaattgtaaaggaaattctgtgcgtaaacatattggctaaagttgaaggagcatcatccagtttttctgcaaattgagcattcaaataaaagcacaatgtgttctcttaaagcactaacctgttctttaacaaaaattataaagggttaaaaagagtctataaaaatcttaccttatggtcaaacattaaaattgggtaaatatgtctaccagattttattaaaattgagtttaatagcacactaatataaaggtgaaatttggcttatctggtataaaatcatacaggaagcattgtcaaatatcaaatggtgtttggctttcttttgactatatttgtataaatatgttattggtatgtgttccaaaattatgggagactcctataattctgataaatcttattgtacattatcagtaatagttataattgttatgttaaaattattatgtgccacagaggtaacagatatccttgtcaattgtgtctttaactatggctaccctaaaactttttgttatccataaacaattgttgtcttgttttggtcctctttagaaggtgtttttttttaaattttcttattattatactttaagttttagggtacatgtgcacaacgtgcaggtttgttacatatgtatacatgtgccatgttggtgtgctgcacccattaacctgtcatttagcattaggtatatctcctaatgctatccctcccccctcccctcaccccacaacaggccccagtgtgtgatgttccccttcctgtgtccatgtgttctcattgttcagttcccacctatgagtgagaacatgcggtgtttggttttttgtcattgcgatagtttgctgagaatgatggtttccaatttcatccatgtccctacaaaggacatgaactcatcattttttatggctgcatagtattccatggtgtatatgtgccacattttcttaatccagtctatcgttgttggacatttgggttggttccgagtctttgctattctgaataatgccgcagtaaacatatgtgtgcatgtgtctttatagcagcatgatttatagtcctttgggtatatacccagtaatgggatggctgggtcaaatggtatttctagttctacatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcattgtggttttgatttgcatttctctgatggccagtgatgatgagcattttttcatgtgttttttggctgcataaatgtcttcttttgagaagtgtcggttcatatcctttacccactttttgatggggttgttttttttcttgtaaatttgtttgagttcattgtagattctggatattagccctttgtcagatgagtagattgcaaaaattttctcccattctgtaggttgcctgttcactctgatgttagtttcttttgctgtgcagaagctctttagtttaattagatcccatttgtcaattttggcttttgttgccattgcttttggtgttttagacatgaagtcctttcccatgcctatgtcctgaatggtattgcctaggttttcttctagggtttttatggttttaggtctaacgtttaagtctttaatccatcttgaattaatttttgtataaagtgtaaggaagggttccagtttcagctttctatatatggctagcctgttttcccagcaccatttattaaatagggaatcctttccccatttcttgtttttgtcaggtttgtcaaagatcagatagttgtagatatgtggcattatttctgaggactctgttctgttccattggtctatatctctgttttggtaccagtaccatgctgttttggttacggtagccttgtagtatagtttgaagtcaggtagcgtgatgcctccagctttgttcttttggcttaggatggacttggtgatgtgggctcttttttggttccatatgaactttaaagtagttttttccaattctgtgaagaaagtcattcgtagcttgatggggatggcattgaatctataaattaccttgggcagtatgggcattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttagctctctgtttgtctgttattggtgtataagaatgcttgtgatttttgtacattgattttgcatcctgagactttgctgaagttgcttatcagcttgaggagattttgggctgagatgatggggttttgtagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaacacctaatttattgagagtttttagcatgaagggttgttgaattttgtcaaaggccttttctgcatctattgagataatcatgaggtttttgtctttggttctgtttatatgctggattacatttattgatttgcgtatgttgaaccagccttgcatcccagggatgaaacccacttgatcatggtggataagctttttgatgtgctgctggattcggtttgccaggattttattgaggatttttccatcgatgtttatcaaggatattggtttaaaattctctttttttggttgtgtctctgccaggctttggtatcaggatgatgctggcctcataaaatgagttagggaggattccctctttgtctattgattagaatagtttcagaaggaatggtaccagctcctctttgtacctctggtagaattcggctgtgaatccatctggtcctggactttttttggttggtaagctattgattattgccacaatttcagatcctgttattggtctgttcagagattcaacttattcccatgtaaaagaacagaaattataacaaactgcctctcagaccacagtgcaatcaaactagaactcaggattaagaaactcactcaaaacccctcaactacatggaaactgaacaacctgctcttgaaagactactgggtaaataatgaaatgcaggcagaaataaagatgttctttgaaaccaatgagaacaaagacacaacataccagaatctctgggatacattcaaagcaatgtgtagagggaaatttatagcactaaatgcccacaagaaaaagcaggaaagatctaaaattgacaccctaacatcacaattaactagaaaacaagagggtggttttataatcagctataaagctctaacaggtgctcttgaatgaaggtttctgttaactggagattgtaacatcaaaatagaggaaaaacattcaggacctttgaagagctaaaatgttcattaatgtcaagcagtacagaaattaactgcataaaatgaactaataggagactggagtaatctttttagtgttttgcttaaaacattgctaatcctttgttttgcttttcaaagtcaagtaaacttttcttttgagctattaacagcttttaacaatttagtatgctcccataaacaaaatttggagcatacttgtctctctcttcctgattttctccagaatttggaaactatctgaatattcttaagttgtcttgggacctcaagaggagagagattcatcaactcataggtatttgatggtaaaaatccatggctgggcttggctttaaaaaggtcttatctcagattccttctacggaacaaaattccatcaaagctaatttaaaaggcctatgtaacaaataattattcttgctgcactgtatgcaaataatttagccaagtataacaaagcaaacctgtcctaccatgatttgtcttttaataaaaatgggaaactagagagagaaaattatgtttcaaaaactatggcactcctgttgttagattctagtgtttttcaatttttattattttgtactgcttaaattaaattctaatttttctggctacaagtttccaaaataagctgtgctttcttaaagccctatgaacggaaaactaggtgtttcagggggtgctgcctctaagtgcccccgatcatcacaggaggaaatgtcttcactgttggtgctgacaactaataactgaaggttcccagaatccttcgtccccatgtctagcgagtccacggaacccagggtaattaaaatggcatctgttacaggaatcaactcctaaatatattgcacgcaagtcaaagcctggaaagctaaggaagcaacccctgacagcccccaaaaacgtcctaaatatcaatgtaaagaaataggaaatcttaagctgaaaatcataaaaaaataagtaactgagtgagaactactcatcttactcagtctcacccctacctctccttttaagccaaatattaaaactttttaatggcaattatttattatgccacccttgtgggaattgccttactcattctactatttgcagtaggcctatatactgtagcaccctcagggtgaaatatcagacaaaaaacgtcaattactctagtattttgcttaattattatcctcatagcaggaataacggttactaacagaaaataacatgtgttattgggcctttcctagcagcacctctgcctgtcattatgtaaaaaatgttgtttctacctctaccaattgggcctagtaagaaacactgctgaaaaagttaaagaaagggctaaaaagctaaggaaatatcaaaacaaccaaataaattcttggtttgaaaacaaaatcatagcatgggtcatcccattcctgggccctctcctaataatatgcctggaactaatgttcttttcctgcctaattaacctttttcaagatttttaactgacagaatcatggccatttcatagacaactaccccaaaacatctacaaacggcatttcccctacagtcaaccggagaccagaaaactctctgtcccctcgtcagcaggaagtagcctaaaagaacacgctgtccctcctcctttttatagctatagagtctggattgacagagcaggagcattgccatcttggacaaacccctcattctaagtttcaccttaataaaaaactgcctaaatccaccagcctaatggctaaagtcagcatgaccataaaccacaaataacatctccaaccagaaacattccaaactcctcccccaccagagacatcctagcccctagataagtcccctccagccgggaagatgctagccccgagataaccccgctctgggccggaaagatgtctgccccaagataacctcccctcgtcccagagagattccaatcccaccataaacttctccacacacataatcattccaagcttgtgataagccccctcaccctaaacccaatatatactcttagtctgtaagagtaagtgctcctgactgaaattggctaggaacacctctcaggttttgtccaaagtaaacctgtctttaactgccagctgtatttcgtgtttctttcctctttctttaactcttacagaagagctttagccatgaaggacattgatgtatttgggagggcaaacatgaacatggtgatgtgaagtgggtctgaggtacacttgccaatcatacctcatccctttgtcatggagtcttgagcctatgggagcaagttgaagtctgtacctcatgtatggttggttgaggtgtagtcagtgctgatttaggaattgtaaaaggctgagttcacagatggacaatgcaaaacagtccagctgaagcagtttgggagaagacagaacctgactgaagattccaagcaagggcttatatgacccagcctccccgtatgagacccagacaattgtcatcagataaggaacaaagactgcgtcagtgattcatgtaaaggagtaatttaagcaagagctctcactgttggagcaatatttctacaggtcaaccaagcgtgaccatttctaactaggaaaatgcctttggataataaactgtctcctatacgcaccatgcagcgaacttgcttcatcttcatcaattaaacactcccaattttctcttccctggtatctgacaagaatctattttctcttttttccatgtaaagagagggtttttggaggctgagagtggtattagtgggatttgatgttggcatccccataattcaagttctcaattgctgttcccactactgcagggcctcaggcaaaacctctaaccttggtttcccccaaatgcataataaagagaagagtctttacttatttatgatgggctctgttacttgtatgagagatgttccaatgtaagtattattacaaggtccaatttactgtccagaaagaagcaatcctgatagaaatctttcatttaattaaaattgattttaaaattgcctgatcaataatgagttaaaaattcatcctggctcagtgggaggagagaggcctccaagcaatcctcactggagtgggttttggctcaagagtgaggtgggccttgccggccctgcttgactggccaaagtctgatgatttttcttgtggtccagacagccaagccctccttgagagcaggaggacatgcaaaagaatctactcttatttcttgcattttgagcagaaaagtttaaaaaaggcaactgaccttgctagttaagcttgaaccatttaacttactggaaaccaataaaaacatttacttattcattttgggggaatggatggtgcatttgcttgaaagctccctcccccagctacagaggcccttttccacatgtgcggtcactccagctggaaaaattgaagctgtcttcccaccctcccatagcctacactcccacatgcaatcatttgctaaattctaccagttcaacctctgcatctctggctcttttccatccccattgctcctgccctgggtcatactgtcttcacctcttacctggaatatttaatagctgtctcactggtttccttggcccacttgtccacctgtctaattcattttccatgctcttacctgagaaatctccttaaaaggtaggtcatcttgggttactgctgctcaaaaatctttggtgatccacattttaataaggaattaagtccaagtgccttggtgggcattccaagacaccataaatcagacctcttgccagcaagtaacatccactgtgtgtctcccaacaggctgccaactctcttctttcctcccatactgtgctactcagcactctgataacatacagaactcttctaggcctctgtggctgtgctcacacgatttccaattccccctaattaaaacacgggtttgttcatttgacaaatattcatttggaaaaggctatgtgcctggccttgtgcaaggctaaaatggaagttagggggaaaagatgtatttgacaaagcccctgctctcctggagctgacatttcaatggggaggtaagctattaaaacaaacacccagcactttgggaggctgaggctggtggatcacaaggttaggagttcaagaccagcctggccaagatggtgaaatcccgtctctactaaaaatacaaaaaaattagccaggcatggtggcaggcgcctgtaatcccagctagtcgggaggctgaggcagagaattgcttgaacctgggaggcggaggttgcagtgagccgagatcacaccactgcactccagcatggatgacagagtgtgactccatctcaaaacaaacaaacaaacaaaaagatgaaaaaatagagatgacggtaagagttatgaaataaatcagtggagccctatggtgagtaacacaatctggggctggggggatccaactaaatagttgggggctgcctttcagagtaagagccgtttacaccgagaaatgaaggatgaggatggggcagacaggtaagacgtggaagaagcatggggcagaggagacagtgattctaagaagtcgaggtgggagggacttcggtgcattctaggaaagccaatgctctgggaacataaggagattttttttttttttttgagaaatgttaggagataaaggtagaatgtcagtgccagatcatcatggctttgtggccatgtaaggggtttccactgtttttccaagtgtgttagtttcttagggctgttgtaacaaagtaccacaaaccgcatgcttaaaacaacagagatttatagtctcacagctctggaggccagaatcctgaaatcaaggtagggccatcctctttcccaagtttctaaggaggatccctccttttccttttacagtgtctggtgtcctgatgtgcttcttggcttattttagcttatctccaatctctgtctctacatgctgctctcccagtgtggtgtctgtgtctgtgtccaaacttccatcgtcttataaggacatcagtcatattgcactaaggaccaccctaattacttcatttcaacttgattaaatctgcaaagaacttgtttccaaataaggtgatgtcacagtcacaggtactaggaattgaacttgaacatatcttttttgctgggggagttgggggtgggggggacttacagtccaacccataataacaagtgacatgggaagcttttaaagagttaggcaacactgttgcccaacttaaaaatataactcctttgatgcctggtgagaaatggagtgaagggtcagatggaacctggagcctagtcttcccgatgtgggatgtgttggcatctgagcctgagataaaagggtgcatacgcatgtgttttggcatgagcacacacgggtagccatcacattctaaaggcaatttccattctgcaccctctgtgatgccttgcaaggcatgccttttctttgtgctttcatagcctttggcttatacttttatttggcctgtgtttagttttaccctgttttagaattatatgtgtagcaggactgtcaggagtgaagacatgtcttttgtaggagggcttttgtctaaataagaaagaggaaaatgcttgcacacacagctgtattgaagagggattgaatagtttagcgatttcacagagagtgactccctgggtcaggcccatggattcatttctgagcattgtggagaacggggaaagaagggactcaggttaaagagcagaaagagccgcagttccatagaaaccagggcacagtcctggtggtgtagggctcagggaacactgttactcagaggggaagagagaggcattcatccctgctgtcagctgaatgtatgtgtcccatcaaaattcatatgtggagacttaatccctaatgtgatggagttaggaggtgattaggtaatgaaggtggaaccctcttgaatgggattagtgcccttataaaagagatcccagagagctcatttgctcttctaccatgtgagaacacagtgagaagagacaatctatgaaccaggaggcatgttcttacaaaacacggaatctgcaagtgccttgatctgggagttcctagcctctagaattgtaagaaataaatttctcttgttcataagcaccccagtgtatggtgttctattataacagcccaaacagactaagacagtcctcctcttgcttatagaatagcttggctgtaaggacatctaagacttctcggatgcattggtatcatgtgtttgtggttttgggatcttcagaagtcaaatgtctaatcgattccagcactctttgagtggacggtggccagcgtgattgtggcaagatggtaccctcatgcaaaatcatgagattctgaagtgccatcagcacaaaagaatgggagaaatcagcttgtgaaatcattcaagaacctcatgcatacctggagaaagatctgggaaagtctagtggaagcttgctgtttcccatgtctagtacatgaacctcttctgatgttggagaaattgcccactgtatgagacttcaggaaaggccctgcctacctctgaccacagagccacaaagcaaggcacaggtacccactgtcccttctttctttgaggttagtccctatggttgtatcatctatgctcagccaatcagaaatactgctccaggactttggaagctatagaagcaaagaagcagtgacagtggagaaactccttcagagtgggtgatgatagcaagggcggtggcagaaacacccattcccatgagcagcggtggtagtaccatgggccttcatgtttggtacagatggagtatggctgtgtgatgaactgaaaaatgggcctccaaagattgtggctgtttccttatatggtaaaatatctgataaagtgaaggatcttgagaggaggagtttatcctacattatccatgtggcccctaaatgcaatctcatgcttccttgtaagagacaggcagagggtgttttgagagagatagacagaggagaaggcaatgtggccaggaggcaggatatggccacaagccaaagaaggcctggagccaccagaagttggaagaggccagggaagaattcttccctaaaacatttggagagaatatggctctgcaacacaccccaattttgaatttctggcctccagaactatgagagaatacatttctgtttttgatccacagagtttgtgataatttgttaaatcaggtacaaaaaacaaatatatcttcctgtttgttttctgggccaggtgatcccaaattcctagcaattctctgagccatcctttcaacaaattttcttttctgcctaaatcagaggcagtttctgttgcttgtcattaagagctgggattgctagagtcaatctttcttgggaggaggggatgacaatgttcagagacaaaaaaaaaaatgctgccccagaacataatctactttgtacccattttctgctgagccctagagaaaaccagcttacaatggccataatatttctgcctccttcatcagccactgctggtgccactccttcatcagtctatgtacatcatcccagggagatcaaaagtacagaacattggttaaccttagccttcagtaaggatgttaattttctcagatatgggagagaaataaggaaggggagagattttgatggggagaacacattgaaggtactaaccccatctggtgtaagtcttctcagaatgctgagcagctccttagaatgtgagtgttgcaggtttgggaccaagatggtgtgaatgagtggctcacacacaccctttcttacccatgcctgtggcagatacgactaatcaattcttgtactctttttctcacaatccttctaaaacagtgatctgaatagctgttctcaattgtttggatgtagaataggatataaaatctattggcatttttagtttgtaggcttgaggaaaggagagacagatagcacagagtaagcaacgggagctgaatgcaggaatgacttagcatctgtgaaggcctgagaggaacatcaggacattgcagtgaatctagtaggtgtatagttataactttctcctgcaggtctgttgggccaaatattgagtccgagcatggtcaatgggttttgttaagaggggaaggtagaaggactagaaggtaaggagacacttacagtgctcttgatatggttcaccaggagtctcctggactttcatgaagtggatggagaatgagagcactttaatataggtttaatgatgcaataatgagaaagcgtgcagggtcaatggaggcaaaatgataaaaggtagagtgcagaaggaagtaacagccagaacatgggatttcaaaacgtgctatcagaggtgaagtagttctgagggatggttgcatatagtcatggccctgtggaggatgactggtgtggggtggggaatggaagatgttgaacttaggagatcaagggaatgcaagttcaatttgctgcatgggtttgcaaagtggacactgagatgaagaggatttgtgtcaaagaggaaaccaatcaccaaaatataaaagaaactcaaacaactcaacaacagtaacaacaaaaccccaaatatcctattaaaaagtgggcaaagaacatttttcaaaagaagatatgtaaacaatcaacagacatatgaaaaaatgctcaacatcactaatcatcagaaaaatgcaaattgaaaccataatgatgtatcatcctactccagaatggctattattaaaaagatttaaaaagaaatgttagcaaggatgtgcggaaaagggaactcttatatactgttggtgggaatgtaaattagtgcagcctctaaggaaaacagtatggagatttctcaaaaaactaaaagaggactaccattgatccagcaattccactcctgggtatctacccaaggaaaataaatcaatatatcaaaaaggtacctgtacttgtatgtttatcatagcactattcacaatagcaaagatatggaatcaaactaagtgtccatcaacagacagatggattaaaaaatgtggtaaatatacataacagaatactagtcagccataaaaaagaataaaatcatcttttgccacaacatggatggaactggtggtcattatcttaagtgaagcaacccaggcccataaagaaaaatattacatgttctcagttttcactggttattaaaaaatctgttcacatgaccatagaggtggaatgataggtaacagagacttggaagggtgagggggtgtgaagggagaggatggtgagaaattacttaatagtataatgtacattatttgagtgatagataccacaaaagtcctgagttggttgctatgcagcctatacatgtagcaaaatcacacaggtacctcataaatttaaacacatttatagatatttcaaaaaaactacagtttttattcaaaattcagcattgaatattaaaacaaagaatatggctaggcgcagtggctcaggcctgtaatcccagcactttgagaggctgaggtgggtggatcacctgaggtcaggagtttgagtccttccagtctggccaacatggtgaaaccccatctctacaaaaatacaaaaattagccaggcatggtggctcacacctataatcccagctactcgggagactgaggcacgagaattacttgaacctgggaggcagaggctgcagtgagctgagatcgttccactgcacgctagcctgggcgacagagtgagacttcgtcaaaaaaaaaaaaaaacaaacaaaaaaaacaaaaccccaaaagcaaacaaaacaaaacaaataatatatagtttgaatacttctatgagtatcagttttttattccttgatttttcttggccacgtttatgatgataaagtataaccgaggtgtcaatatgcgttgtgttttgttttcattgaattctcccctcctccagctctaagaagaaggtaaccagaactctgtatgctttgattctctttgttgttggataagatgggaagatgcctggaagtactctcccaacccattccccattccatgtcaaaaacacatgcacttggtgtttacgacttctgtttcacaaactataactctttgatgtgattgtgccagggagaggagaaaagggagcattagtgagggtcccaacagaaaacagcacacgcacatgggctagctgaatgcatttaatgagggagcaatttacaaaattgtgggaaaggttaaaagaaacaaagaatggtgcagcactccatggctaggaacagagaggagcctttaccagctctagatctgcaaggtacggaagtgattactaaaaccagaaccagccaccagataagagctgtggcccctggtagagggagaagcccaatctgtgatgaccggacaggagagaatctgaggaaataaaacacctacttcactctattcctaccttccaatatggcaccttccattggctgaactcgtaaccccattaaccaaacccaaatcaaggccaggaggcaagagagttggttgatgtggaacttaaaggttagtctccaaatactgagtaggtggtatgcgtagctctggaggggaaatggaaaatatctagcttagggggtgagtacctttttggggtgggaaggagacaaaaaaggaataaatttcccaagacagagcagcatagtggttttgggcttcaggaccagatttagcgggattatgtgcctcagcccctattgtacccaggggtgggacagggtttcacagagcacccagaggctgtattctcagtgccaggtgtcccagcctcagacaacagaacagaaacatagaacaaacccaaagccaagagagctcctgcaggagattctgtgttgcaaaaacaattaatttatctttagaggagaaagactctataatgtgtaaggtcaaatttcccacattctcgcaggattggggttaagaattagaatgaatttgcatttagaaaaaccaagtaactgtatttcctgcatgcttaggatctgagagtgaaatttgtattgattatgctaataaatgaattcaagtataataaaaaagtcttaacagataattcagactaatccaagtgctccttcatgtctgaacctctccaatgcctcagatatgtgtgagtgaaagagggtgcaggcttgggtgcccctcctaagtcggaatgggcctaaaagcagcagagttctttcagaatcttacaggacaatgagacaacaagttatttggtgaggaaagggtcaacactggtctcagattcatccagaaatcagactactccagatagaggctctgccatcaagctggtatttttggttaatcacctgacacgctcttgattctgtctttccctggtttgagcagcggcatcaacagcctcaagaccttgaagtcaaattgtgccattggctaaaagttttgcagagctccactgtgttgtggagagctcactgtcatcccctccagctggcagcccattgtatgcctcatggaatggcttaggtgtcacatactgagatgtgagtgtcatttaaggatgcgaggagagaaggcttgaatgtgcacagagacagccaagaggatagcattagggtgggaagaactgggctttgaatcagagtatgtgggtgcaagtccatgctccagtgctcaccagctgtgtgacactggacgtatcacttaagctttctgagcctctacatctatgagagataggttatgggacttgttcaaatgtacacagatggaaagtgcagcaatccaaattctaactttgatctgtccaatttattattcgttcatcgaaaaatgtttactgaacaagtcattgtgccagatatggggaatatctcctgtcattgagccatcaaggaagaaagagcttaaacaaataataatgagtgtggttagtgctatagagaagcagagggtctattagaagaatataaaaggaagaacagtaaatggggtaaaaaatggtataatttatattctagtagaacactcactattacagctattattatctaagatgcagaaacattttatgcacaaatctattagttataatattattcataataacaggaagttggaaacaacctaagtgtccaaccataggggaccagttaaataaattgtgccaaattgttgtgttatataatagagtcacttaaaatgatgcttattatagtttatgatgttatgggggaaacataccgtaaatgtgtgaaaaatacagagcatgaggttgtttatactgtataatctcatatatacttgaggaaagagcctatgtatgtaatatatgtaaactatataattcacatgtatttgggtgaagagtatgtgaaggaagaacctagatcattctgagtagtggtggaaattataaacaattatttttatttattttttcatacatttcataaattccctagcgaaccaaaggaaaataataaataaaacctcatgcagcactaatgtatttgttgaatacctgctctaatgtcacaagaatttatgtggcccttaggaatacaggagatcataaggtatgtcaaggattcacctaggaggagcccatatgcttgctgggatacacaaaataaacatatgctgcaatagaaaacaagatgatgctaaataataataattcaggcaattcactgagtgttagcataacagcaacttgccttaaatgagcatgtactctacccgagatactgttgtaaatactttccacatgtcatcaccttgcatgatgggaacacacattactccattttatggatgtcataattgagactgagagagttacttagtaactttgctaaggtcacacaactaataagtgatgaagtcagattccaacccttgcttttttaatattaaggctgggctcctcatcattatgctgcaatgcctatgaacagctttctagggaagagaaaagttgaagttggccttaaagaatggtaggatttatagagacacaggaaccacagcagggaatggaacatgggggacacataatttgatattttctgaatacttattgggttcttctctgagctagacgtggggagaattgggtggcctcagccctgctcactgggcacattcattcaatgcatgcttgctgagctcctgctgtatgcccccacacgatgtgcaaggagaaccatggcccccactcttacgaaaaatgcaggctagtggcaggtactgacactaaacataaagcaaaaacaatctgtgaagaaaaataaagctccaattaagaaaagtgaaatgtctataaaagagtcaaaagcagatacgtgtgtcaaggatgaacagaaaggctgggagctggctctgggatctgaattaaaaatgattctcagcttggctaaggatatttggggtccattcacaggcaattctcagaataataattgttaatagggactggaacttaaaacttatctcatcaggatattggcttgacttcatctgaatctcagttacctagtctttacaatggggattataatatctaggttgcagagttgttgcgtgaatgaaaaggatatggcacataaagagttgaccacaatgcctgcagaaggaaaggagccaaagccattgttattgctttagggggcaaagagcaaaaagatggaggtattgtgacttcaaaatctaacttttcttatatgaacatgaattcttttccattggtctttgggtcctactggaatgatatatgatggatccattctttcacagcctatgctctgggaagtgcatatccattgagaaggatttgtgctggtaactgttttctctttttcctcttcttcttcctccacatcctctcccttatgttattattatgtttgcaaagctttatccccttcatatactctctgtccttctctgtaccttataaagtcaacctccatagatcccatcaactggctcccttgctattgtctccaaattgggattggcccgtgggagcttccagctggtgattggaaggaaggagtagggagaggtcagagtgtttcttccccactcccccttggtgtcctgtttctggcaatagcttcctcccattgtgactacagctctcacctgtaggacccttctccaataatacatactccgattattcttgcagcctagggatggtaataactttgcattgcaaatcctgagtaccccttgcttattcccttaactttggcccctgaacctcctatattctggtgatgctgaggatctcacctgagagtgctgctccaggtttgcctgatggtgggcgtgggcagtgggagagaaatcacagcattgacggtcttctcttctccaactcagcaccctgaatcgagttctggtcttgagtgctaattggtctgctctcctgctgaaaagtggccaaagtgaatttgtttgcaatgtgaagggaaccttgagctctggaggcccagtataatgccagtgcttaatggctctgtggagttctgctggatacaaaggagggagaagagagggcatctcttcttccccctaacatctcagcctgtgggagtgattgtatccctgccacttgtctttctaaagaggctgagccgcctgagggctcgaagtcatgcctggtcaacttcttcccttccaggcagagctttgccacctcactcctcaaaaagccacataaaaagtgagatgggattttaaagtggttttatatccctttgtatacgatatggcacatctggaataaggagtgacatggaaatggatgttggtgggcctggtgtacttcaacagatccaacaactggataagggatgacatcactggtattttcccaatatgctctggagttgtaaagaggctgctacagcagcattgctgggggactctttctaaggtccaagtgctctaagaactctgagtagaatatggaaaactgttcttgactgcctggcatgttgactcttcctgttctatagactctgtgtttctggtcataggcatagtcatatgaagctcattccccaggacatgcagatgaatccttgcatgggcctttgatcctaacaaggcaagttaaattccttccctaaattgatgttatgaaaggaatgatctctctggtctcaaggaggcatggaaaaagtcatttgcaatgggaaagcctgagaatgacacatggagaaaagtagatttgaacaatggaaaaggtgactacatagtgaccacactgttcaagtgccctgatgcagctgtatcttaacccctggattttctttttctttttcttctcaaatccttagcttacttgctggctgtttacctactctgagttacagttctaagagctttgacagatacagtgtttctacaaaaaattctatggctagtggagcctgtatagacttaggtaacagtgaatgagccctgactccacccattttatatcaggataagttctctaacttatgtgactctgatcacgaagagcgtccactaggaaagacttgattatcttccaaaattgtctgcaaataaaggtacacaggtaatcccaaatttatcaaagttgctgtagccagggcaacactccttgcctttgcctgcctcaagctaggaggtgatggggactacaacccctaaggtgtcatctgcctttcaggggcaccaggatcctggttcagccaggacgagcatcaggcctgccaaagcaggtattcaacaaactctataaggtttgatcacaactagataaaacaaactaaccaaaatatcttacatagaaaaaatactaggaggaaatgcagtgaagtgattacatatgttttcttttcttttctttctttttttttttttttttttttttttgaggcggagtctcgctctgtcgcccaggctggagtgcaatggcactatctcggctcactgcaagctccgcctcccgggttcacgccattctcctgcctcagcctcctgagtagctgggactacaggcacccgccaccacgcccagctaattttttttgtatttttagtagagacagggtttcaccctgttagccaggatggtcttgatctcctgacctcgtgatccacccgcctcggcctcccaaagtgctgggattacaggcgtgagccaccgcgcccggccatgttttcttgtaactaagaattttttccaatcccctaacaatttttgatattttctaaatgttctaaggtgaacttgtattatatttataatatagaaaaattctcttatgtataaaacaacatttgttaattgaagaaagtgtgaattgtcttccactgcccagaggaaaatgtgagaaatccctggaggaaataagtagagagaagtagaagtccctggttattttttgctctcagagcttgatgtgttgagaattttgtgtcaaggtctttgacctatatcctgaagccttgctctcacctctcaccagtaggatttaggggcaaatggcagagagtgctttgtggattagcaaaatcctaagtggatatttttgcaccacaaattgcatccatgcaggtgtgaggagttggatttctccctgtgcccacttttctattctccttaaagaagatgagctgttaaccagaattagtctctgttctcctgtactctttcaggtttctctcatagggaaggaggaagagtctgtaaggaaggacatcaggagacactttgcaataaggatcatgtcagcggttgaagcaaagcagctgaaacgactcagcctctgataacacatcttctatcagcctatttacttatcctatggactaccctgggacagcagttctgattctaggactcccataaaacccagggcagattcactcagttcctccaaacctctgcctgatcctctcctcccccatttccatcacataattcctcatggtgagaaagcaggttgtgtttatttagataaagatatattactgtaatagaattactaattatgttaaacaactttttccttaaacaaaacattccatggttggggatggaaaccattagtgtgagtaggaggagggaggaggagaagagggaagttgtgtttttctttccccctgatttatgaaggtgtgataatcttggaccgctcacaagttgagcttttccgtggataactggattctgctttgccagctataatttgaagcaaattttgctctaaccaatctcctcctccacattaatgtttattaaaagtcagccacagcacatacagatgcctccaacaccatggccatgcccccagggccaactccaggttattgcaagggaggtgggaactcctacctctgctttgctttcacaaagcatgagcaaaataggaggactggggagggaatctgtagctccgtactgaagtcagcagacaatgctgctttgggggttgttggtattacaaatgttatgtaaggacacagcaatactatgagtctttagtctggaatcccttaggggaatatgaggagaagggactgattactatacactcaacatatgaagctttgggaaccattgtaagcgtttccttttatttcctgcatgtgtctttccttaattttctccactgagaagatcatccttaccatctctgcctacttcattgagccaacagacttgggttggattcccccaaaagcaaacttggagacaaggatgtgggtgcaagcagttgatttaggagggggtccaagaaaacactgttaggggagtagggaagtgatatggtttggctgtgttcccacccagatctcatctgaattcccatgtgttgtgggagggacctggtgggagataagtgaatcatgggggcaggtcttaggtctttcccatgctgttctcaggatagtgaataagtgtcatgagatctgatggttttataagggggagtttccctgcacaaactctctttgcctgctgccatccatgaaagacgtgacttgttccttcttgccttctgccttgattgtgaggcctccttagccatgtggaagtctaagtccattaagcctttttcctgtataaattacccaggtatgtctttattagcagcatgaaaacaggctaatataggaagtaagaaggaaagagaatgagtcaacagagggtccactgatgaacaggtttctgctattggtaactgtgattcattctcactagatatctcagaaagtctgtatagtacaggccttggagctcccaggactgaggactctggggtatcaatctactaacttctgtctatcactgattaagggctgcttctggagtgttagtttcttggcacccctggtctgtcctgcacatgagaacactcctgcagtgagaagatggggtatatgtacttttccctgttcttcccagtaagcacaactaaaaatcctggatattatgtgtaaaacaaatatactaatattctgacaggaggagagaagaaggcagactggctaggatctcaacacctgaggaatgatatgatggtgaattcctttaagcttccattctcccagctgggcacggtggctcacgcctgtaatcccagcactttgggaggccgaggcgggcagatcacgaggtcaggagatcgagaccatcctggctaacacggtgaaaccctgtctctactaaaagtacaaaaaattagccaggcgtggtggtgggcgcctgtagtcccagctactcgggaagctgaggcagaagaattgcttgaacccggtaggtggaggttgcagtgagcagagcttgcgccattgcactccagcctgggtgacagagtgagactccatctcaaagaaaataaaataagaagattccgttctcactcatatacccaagacactgcactgaagaatccagaaacctggaaacacgaacgtgcagattttttttttaaaccatcaccaacaagattattaatatgttaaatgcatcttataaagatgtttaaaaatccataataaaaatatttcaacaagcaaatataaatgtgtctaaaacaaataaaaaataaaaagcctcagaaaggaaagtcacagttagtaaataaaagatacaaataactgccacatgaaaattttagaactgaaaagtatcataccaaaagaaaaagctcaatatatggattcaacagtagaattaagggaacagaggaaggaatcagtgaacttgaagacagaacaatagagaatgctgaatctgaacatcaaagacataatagactgaaaaaaattaacagagccttaggcacctatgacactgtaacaaaaagtctaagatttgtattattagatacccaaaggagaggagaaagagagcacaattgaaaaaaaacttgaataaacaaatagtggctgaaaacttcccaaacttgctaagagacgtaaacatacttaagaaactgagtgaatcccaagtagggtaaacctaaagaaatctatgtctagacacaccaaaattaaatttctgaaaactaaagacaagaaaaaaactcttaaaagcattaaaagcagtcagagaaaaccaacaacttgcctattagggagaaacaatttaaaagatcatggattttacattagaaagcatggaggccagaagaaagtgacagagtactttccaagtgctgcagtgaaagaaccatcaactcggactcctgtatccaatgaaaacaaccttcaggaacgaagggaaaatcaagacactctcagataaagaaaaatcaagataattttttacccatagatgtaatctaaaataaagacaaagggaatttgtctaaacaaaaaagaaaaggataaaagaaaacaaagactgtattaaggtaaaaaataaaagaaaatgtaatagattttccttctcatctttggtttgttgactaaattacatttgttgattgaacaaaagctatgctatctgatgttaatatggttctcatgtatgtaaaggaaacagttcagacaattatgttgtaaatggaaaagggcaagacaacatagaggcaagttttcttcaattcacttgaactcgtaaattatcaacaccactagactgtgataagctatatatatgtttaagaaagctatttttaaaagctatttaaaaagatgcacccaaaaacactatgattaagtcgaaataaaatgctaaaaactgttcaagtaactcacagaaaggcatagagaaaaaataaaacagatagaacaaaacagacaacacaaaataaaatggcaggcttaaagcctaacccatcaataatcacattaaatgtagctatttcaacacaccaagtatgagacaaagattgggtaaatgtaaatgcctcaatataccaattaagagacaaagattgggttagaaaacaagaccaactatgtgctgtctacaggaaactaatttcaaatataataaaataggtaagttcaaagtaaaaaaattaaaagaggtctatgtactatataaatattaatcaaaagaaagcagcagttattatattaatatcagatagactttttaaatcaggaagtttatctctattattattatactttaagttttagggtacatgtgtacgacgtgcaggtttgttacgtatgtatacatgtgccatgttggtgtgctgcacccattaactcgtcatttagcattaggtatatctcctaatgctatccctcccctctgcccccaccccacaacagtcaccagtgtgtgatgttccccttcctgtgtccatgtgttctcatcgttcaattcccatctataagtgagaacatgcggtgtttgtttttttgtccttgcgatagtttgctgagaatgatggtttccaatttcatccatgtccctacaaaggacatgaactcatcattttttatggctgcatagtattccatggtgtatatgtgccacattttctgaatccagtctatcgttgttggacatttaggttggttccaagtctttgctattgtgaataatgccgcagtaaacatacgtgtgcatgtgtctttatagcagcatgatttataatcctttggatatatacccagtaatgggatggctgggtcaaatggtatttctagttctcagatagactttagaccaaagaaaactatcagggacggaaaggcacatcacataataataaaaggatcagtgaatcaggaagacatagcaaacccaaatgtatatacaatgaaaaatagagacataaagtaaggaaagcaacagttgatcaaattgaaagaagaaatagacaaattcacaattagagttggggacttcaatacccctctttaacaaatgatagaacaactggacataaaatcgggaaggacatagaattcaaaaacattaacaaccaacaagatctaattgacatttataaaacattccatccaacaatagcacattatacagatggtccccaaattataatggcttgactcatgactcatggtgtaaaagtgatatgtattcagtagaaaccgtcctttgaattttgaattttggtcttttcctagcctagtgatatgaagtacagtactctctcatgatgctggtcagcaaaccccagctcccagtcagccaaattatgtgggtaaacaactgatactctacagcatgctgtgttgccagatgattttgcccaacaatagggtaatataaggtgttctaagcacatctaaggtaggctaggctaggctataattttgataggttaggtgtattaaatgcattttcaacttaatattttcaacttatgatagatttatcagaatgtaattccattgtaagtaaaggagcatctgtatactttttttaaatgctcacatgaaatgtatataaagatagaacatctcttggatcatagacagaactcaacaagtttaaaacaattgaaattacgtagattgtttttttctgaccacagtgtaatcaactggaaattaaagaaagagataacaaagtattctccaaccacttagaaacaaaacagcatacttctaaataatttatgattcaaagaggaagtctcaagaaaaatttaaaaatacatgggaaattttaaataaaaatataatgtatcaaaacgtttgggacacagctaaagcaatgctgagagaaaaatttacaggactaaacgttttattttgaaaaaaggaaagatttcaaataaatcatctcagttgtcttctcaagaaattagaaaatgaggaataaaataaaaccaaggtgagcagaagaattaagaaattacaaagatcagagtagaaatcaataaaattaaaaacagaaaagcaatagagactatcgatgaaacaaaaaactggttctttgaaaagatcagtaaaattgacaaacttctaacaagactgatggagcaaaaaatagacaagacaaaattaccaatatcaggaatgaaacagagggtatctctacagaccatgcagacagcaaaagaataacaatgaaatataatgaagaacttgacacacaaatttgagaacatagatgaaatggaccattccttagacaatacaaactaacacagctcacctagtatgaaatagataatttatatagcccaataaccattaaaaattaaaggtatatataattaaagccatcagaaagaaatcttcaggttcaagtgttttcactggagagttccactaaatgtttaaacaagatttaatgtcaattctatgcagtctcttccaggaaataaaagagaactgttcccaaataattttataaagccagtattatctggataccaaaaccagacaagaaaggcaaaaaagaaaaaaaagtgttgaccaatatctctcatgaatatagaaacaagttattatgaaatgttggcaaatggagctctgcaacatgtaagaagaattataaaacatggctaagggggggtttattccaagtatgccaagactgttttaatatccaaaaatcaatgtaatccccacattaacatactaagataaaaattgtatgataatattaatggctgtagaaaaagctttgacaaaattcaataaccattaatgataaaaactctcagaaaaacagaaataaagtagaacttccttaacttgctaaagaacacctacaaaaaaatgtttaatgtaatattagtggtaaaagattaaacatttttcctccaagaatgaaagtgagacaaggagttttcttaccactgctattccacatagtagtggaagtcttagccagctcaataaatcaaggaaatgtaataaagagtacacaaattagaaatagatgacatgataattgtcatagaaaatcccaagtaatcgacaaaaaaactgctagacataagcaaattaagcaaagttgcagggtccaagctcaacatacaaaagttaattatatttttgtatgttaacagtaaacatgtgaaaacagaagtttcaagtatcatttaaatcattaaaatattgaagtgcttaggtgtaaatctaacaaaatatatacaggacttgtatgctgaaaactacacaatgctgattaaagaaatcagagaagatctaagtaaatgaaaagacagaccatgttcatggattggaaaacaatatagtcaagtagttactactcctccagttgataagttagtttaacattcttataaaaatcatagcatttttgtatagatattgaagagattatccgaaaacttaaatggaaagggagggtaactagatagctaaaaaacaattttgatgaagtagaataaaactgtaggacttaatatacccaatttcaagccttattatatagttacattaatcaagactctatgatactaggtggagagatagatacaaaaagcagtgtaacagaaaagagaagtcagaaaaaggcccacgcaaatacagacaacagttttcttttaattaaaattctgataaaggtagttgtagattcacatgcatttgtaaaactaacatagagagatcctttgtaaactttgcccagtttcccccaatgataacatttgcaaagctatagtataatttcacaaccaggatattaatattgatacactatattagctttatccagttttatttactcatttctatatatgtgtgtgtgttactaagtttcatacaatttatcacctgtgtaggtccttgaaccccctatcacaattaaaattctaaatagttctaatgccgcaagaaccccttgggttgttgttttataaccacttccctcctgttcctttgaaattccctctctcccatccctaactcctggaaatttagaatatctccactgtttataaaatgtcatcattttgaaagtattatagagatggaattatacagtaagtcaccttttggagaaattcttactcagcagactacccagagttgatgcatatagcaacaattcattcttttttcattgctaaacagtattccattgcatgcatgtataaccattcaccattgaagggcatttgggcagatttcagagtttggctgttacaaataaagctgctgtgaacatgcctgtacaggtttttgtgtgtacagaaattttcagggaagcgcaagtgagatgtggcacaagacagaaggtgcttgagtaaaattatttgaccctgaatctagctatacctgaggtcatcaacattcccttcaacttcttaattgtgagggagtttatatcacttgttttatattactaaaaagcagtcacttatcaggtattcacagtgggtcatctcttatgtctttgccccaaaaagtacaaattactttttaaagaagtttggcccctggaggccaatgaagagttttagcaacataagcctgttacatagaacaggggagaaaggttcctaatgcattttgtacttcattctatagttagcttttgaaaatatttggcataaagtaaatacttactataaatatttggttccaagataaatgctcttggtattctccaaagtctgtggtggccagtagggttcaggaaccctgacatgactccacagtggcccctggaccacggaaaagctgccgatggctgtgatgatctgtggtagctgatggctggtcgtggagagaggatgctgggtgatgacagcactgtcaggggatgatagaccaggtccagggccccatagattgctatgtgagatagtggtgttggctgtcatctgatttgtcattattaagaactgacttttggccaggcctggtggctcactcctgtaatcccagcattttgggaggctgaggccggcgaatcacctaaggtagggagttcgagaccagcctgaccaacatagagaaacccagtctctactgaaaatacaaaattagccaggtgtggtggcaaatgcctgtaattccagctactcaggaggctgaggcaggagaattgcttgaacccgggaggcagaggtagtggtgagccgagatggtgccattgcactccagcctgggcaacaagagtgaaactccatctcaaaaaaaaaaaaaaaaaaaaaaaaagaaaagaactgactttttcaaggtgtcagtagatttggtgaataaaaaaaaggactgacttcattcaggtagagataaactggcacctgagcctctgtccttctggaagagaaattacatatgtttcggaagctcagaataattgagagcaaatttgcatttaacttcaacagaagccagtttggacactgaagtatcaatatataaaaactggagatcatcaataaagaactagaaagatagacatctttatttgcgtatggaacagacactttccaacaaatactaaaagaagatgaatctcaacatttaaaacaagttgatgaaaatagataaattggatgatatcaaaggacaccattacaccagtcagtaaaacacagtaaaaacacagttttacaccagtaaaaacacagtccatgaaataggagaaaatatttgcaagtcatatgtctgaaaagaagtcaatatctagaaaatatagagaactctcacaactcaacaacaaataacccaattaaaaaaattggcaatgaacttgaatagaattttttgtaaaaatggcatataaatgaacaataagcacatgaaaagatcttatcatcactaataattaaggaaatgcaaatcaaaaccccagtgagataccacttcatacccattaggatagctattatcaaaacaataaaacacacacacacatacacacaccacaaaatgacaagtgttggcaaggttaagaaaaaatcagaacccttgaccactgttttgagcactgtttctgggaatgtaaaatattatgtatggaggttccctaaaaacttaaaaatagaattgccatgcgattcagtaattccacttctgagtatatactaaaaagaattgaaagcaggggtttgaacagatatttgtacatctatgttcaaagcagcattgttcgcaatagccaaaagatggaagcagtccaagtattgattgacagattaatggataaacaaaatgtggtatgttcatacaatggaatattatttagcctccaagatgaaggaaattctaacatgtgctacagcatggaggaatcttgagggcattttgttgagtgaaataagcccgtcacaaaaggataaatactaattccacttatatggaatagagtaatcaaaatcatagaaacagaaagagaaatgttggttgccaggggctggaaggaagagaagttattgtttaatatgtacagagtttcaattggggaagatgaagttctgtagatagatggcagtgacggttgcagaaccatgtgaatgaacttaaaatgattaaaatggtaacttttatgttatttattttactaccagagaaaaatagattttataaggttgatatttccataaagttacagttatttcaagacaaatctgaaaaatgcaaaagcaagtagttcccaccatggcattgttcaaaattcatcagaaaaatgaagagccgtttcaggcagctctaaaaaaattctttgaaggtgaattccagtcttcagggaaatctgaagtggctttctcaagatgctgagagaacaaaaggatgagagagtaaacttattattcagaagagaaaaatattaggaaataagaaaggccacatctctgggtggacacctgcaggagctgagtgattgggatcctgctttggtgggggcagcataaatggtgcaaggctggaagccaccagaaaacagagaccatgaaagtaaaaaaagtcacaggcactggcaaggttgtggagagaaaggaagtcttatacactgttggtgggaatgtaaattagttcagccattgtggagtacagtgtggtgatccctcaaagacttaaagacagaagtaccattccacgcagcaattccattactgggtacacacccaaaggaatataaatcattctattataaagactcacgcatgtgtatgtccatttcagcactattcacaatagcaaagacatggaatcaacctaaatgcccatcaatgatagactggataaagaaaatgtggtacatatacaccgtggaatactatacagccataaaaatgaatgagatcatgtccttcgcagagacttgggtggagctggaggccattatccttagcaaactaacacaggaacagaaaactgaatgccacatgtttttacttacaagtgggagctacatgatgagaaaacatggatacatagagggaaacaacacacactggggccttctggaagatggagggtaggaggagggagaggatcaggaaaaataactaatggatgttaggcctaatatctaggggatgaaatgatctgtacaacaaaccctcatgacacaagtttacctatgtgacgaacctgcacttgtacccctgaacttaaaagttgtttttttttttttgaaagaaaacagaggccatgtacaacatgagtccaaatgagttttgaatgtaacaattgatgtgattgagttaaatacttatttaagatctcttgaagaataaagaaattataatttacatgaaattaaccaaaaaagattaaataattgttgcactttaagatcattgaaaagtctctaaactagtaaagctttactgaagtcaagagaaacaaacaaacaaataaacacaggcagaggcaactacttcagaggaagcttccaagttttttcagagttgcatcaaggggagaaaacaaattttcactaaatgtacgatttagagagaatttttgtttttttttgaatttaccctgtaaagatagaaaggaatctttcaaaagcagatgacaagatcagccatgcatgtgataagccaggcacctgtaaatgcaatccaaaatttttccagaaaaattcaaaagaatatgccggctattattgaagccagcttatttcctatgagagaaaaatctcaagaggtgttgagagttctgttgctttaaagacaccttcataagttaagagaatgcatccctgagacaaaacaaattgagaaaggtggtataagttttgaaaagcatccttaagtctccattgttgcaaatggggcatttattagagtcctgtgagatcatgagggaatgctctggaggaccagatcactaaggaaggaggatcatgggctgtggagggatggagatccaggatccagtgcccgctgtgggcagatgccatcctcccaggagaaggaaacttctatcaggtcaactttgttctgacactgcagctccttttcaagagcatgagagagcagttctgttgctcctggaactggtcatggcccagagtctcctttcgatccagccctcccaccagaacagtgtgctgctcacccagtctttgttctctacccagtaccctagtcagatggtagatgtcccagagatattccaaggtacatctcctgagaaggggatacactgaacttccctctatcccaagaaagcttggaagaaactgcctaggggtcttccccactgagggatttccctggctgggcacattctccactagccacaggaaagatctctggaccaaacactgcccacatggtctgaaagcagaagtgagtcatctccaagttgaccctatccccaatgagtagacttctgaagatccagaaccacaagatgtttttttctgtcaactaaaatcattttaattgtttttcttttacttttactgctattaagtaaatggcttaaatataaaccaggtagagctagaattctaaggtaaagttctacgactgtggatcatttaaacatgactcttatgagttagctgcttccattttattctatttttaggtagtgttattacagtagttttcttgttaataaatccacaatataatctgaaacagcaagaaatttgtcttttttctaataataaatttattttttttctcttttggttttattgctattatttatatgtttatataataccttaaatggagatttgatcagattatgacttttaagatagtattttataaatgtagattctatacatgtgaatcttgggattggaaatgacatcagcagccacactgacaagccttgctcttctccatggtgtcatctccatcctcagccactacctagctatgtccagtgacagctgaaattatcacaatggattagaactctccgttccttcagggaagggtcatctggaccaggagaaacaaggtcctctgttaagacccagccctgccgcggattgaccttggacccctgactgctttctggctcagtttcctcttaccactgtcttgtggcagagctgcatgagacttaaacaaggtcatgagcatccagttgtccttcaatctggaacccactgcaggaagcacagccagacttttgagagtgcaagagttttcagacagcacctctccatcctgctctctttctgattcccttcatatcctcctcctcctcccccttctcctctttaccaccaccagcactgttatcattgcctttatttcacttccccacatctgtctctgcacttacttcctttttttctcatgttcaacacatgcactgagcaaatttgtcctcatcccctgggtattattgctggatgtctatcctgcctatatctggacgaatcttattgctggatgcctgtcctgcctatatctggacgaatcttattgctggatgtctgtcctgcctgtatctggaccaatctactgtggccttggggtctcatcaggccatctctctaggcctggaatctggaccatgaaccccagcagtgcctactgctaagttcctacacaaattcagctgcctctagatgcctttgtgcaaactcccatcatctcccctgcaattattttttacttgagatggagtctcactgactttgtcacccaggctggagcgcagtggtgcaatcttggctcactgcaacctgcacctccctagttcaagcgattctcctgcctcagcctcccaagtagctaggactataggcgtacgccaccatgcctggctaattgttgtgtttttagtagagatggggtttcaccttgttggccaggcttggcttgaacttctgactgtgccatctgccatggcctcccgaagtgctggggttacaggtgtaaaccaccatgcctggccttctcctgcaattctgttatagcctccagctccttatccctccctgtctaccttcacaacggtgaagtcagggtaaacttttagaaaatataaaggagatcatgagactctactgctcaaagccctccatgcccccaaatcacactgaggctcaaatctaaacattcaacgaaggtccaccaggctatggataacctggtctttgcttgtctctgtctggcccctccaatccggcttctgactttccttctggaccaataacatgtcacacttacactgcctcagagcctttgcactggctgtttcctctgtctagagtgctttccaccaattatgcatgtggctgcctcccttttctcattgacatcccagcttatattgaatgccctccatctctggcttcctctctggtccccagccttatttatggcttcagactctcatcctctcttaaatcatttaatttccatattattatagtttatatcatttagcccttcttatgacagtcctctaggatagaggttgttgattttagaaaaaaggcaaaattgttgctgtgtttctaaatcattttagtaaacttattaaggtaaatattagtaatattagtaaacttatagtttactagttatagtaacttatagttactaatatgctaatattactaatattagcatattagtaaacttattaaaataccactcattgtttgcactcccctctggaaggtaaggaacagagagtttatcttattcaccacagacactgcctttgtatcttgcacatgagagtcactcacttaagatttgggaaggaagggatacatagaagtgaatccagtgcaaagacctcctgagatctcagatctgtccacctgtcagggcctcccagagcaggttctgtacacctgtgggtgtcttcatgaaatctcaccttggatcctggtgctcctcactgtctgcacattctcggagcatcctcgtgtgtgggtttcaaccagcccccttctgacattccatgcctgcgagtgttaagtctccacattaacgtgattcatacagatggctggggaatcccaaggttgtgggaacagcagaaggagatgctatggaaaaagacatggtacggtggccacaggcctcctctactacagtattgagcagcaaaaggctggtgcttttgtgttaaagagaaagccactggacttcagggacccagtccatttcattgtcttggagagaagatgcagaaatatgcaagtacttacaatcaactgttatctggatttagtaactaatatttatggggtactcactcatgatgcacagagtgctgtataaatgccaggccatcttctagttgtgactacccttatggctactctctaagatggggatggcattcagagaaggaaactgaggttctaacaagctccaaatcacacaatatagacgggcagttgacagctcagagtgcctgggaactaatttcaccttcgtggctctccagcggtgaattttgggtgtgttacttaatgcttaggtctcttgactttctcatctgtaaaacagatgagggttgctgtacaagttaaatgagtccatgtgaaacactcactacacaggaagccctccatagatgttgctgttttttttgttattctactagaagtaaatggcctacttggtattgaatctgagacctctgtccctaaatccactcactttctactctttgaataactgtttttgtttaactgtgtttggtttgttgattgctaaaccagtggaagaacacactttcctaattgaccaggtatgcagatgagatagttttggaacttttgacaagctctggctcattgcagtgacattatttaagttccaatttccagcgaggctggctattctcagagaaatttgattcaattccacaaacacttctcctagtcattaagacacctaccaccagaaacatctggtcaattaaatttaaaacattagtcaaacaagttgttggtattatatggtcagacatctggacaaataaaattttaattgaatgttttgatatcatgtggtctcagtttcaaagccaacccccaaatagaaggcacatacctttactttctatgccaagttgggtgggctgggtttggtatatcaattcacttttaaaaaatttaccaaattgtaatgttacagatatagccaccacgcaattgggattttctacaatagtcctgatttttaaaatattccattcttttgctggccaattgacatgccccagttttttggtagacaatatggtccgtatttgcctggagtcatgagtagaatgcaggaagcctacgttgcaattttggatctggttccatttattctgaaatattcagtgacacatttaacaacttttccccctcaggtttccctttgataacatggaggagtcactttgtattttctaacttaaagggaaggctttctgtagaaacttacgatgttttatacatttgtgagcacacatgtttacatacatgtgtgaggcacatgtagacatactattataatgaatcctcaggaaaccctgtttgccaagccctagtgtagatgaatgacaacagtggcatggattagggttccagcagtggacatacagagtagtgggcagatttgagaggtgttcaggagccaaaattgctggtgtctattaatgcacgagctaagggggcggatggattctgaagaagtatttccactaccaagaaaggcaatgttgggaagaaccttttggtcaacttggtcaacttctccagttccagtagagcaatccagcttcttttgtcatctcctctttatctttcatccagagagcccacataagcactgtttaaatttctcttgacttgtcttactcctttgactcatcgaaaactatcctcgcaaaagaaatttctggcaggtcatgtaatgcaaaaaaaaaaaaaaaaaaaaaaaaaaaaaaaaaaagaactcaaaaacaccgaaaacaaaaaaacaaaatcaaaaaccacttttggacatctgttctgatacagaagccaagagcagggtccgcatggtgccagcgtggcagccgtggccgcatattgcagtcagaatgtgcatggtgccagggctaatgatccgggtttcctgcagagggccgctctgccagccttctaattaggatctgctcagagcagcctgggcagggatgatcacgccttttctcctgccctcctctccctcggttgtcttcctcctatgcagcaatttagcattgtgagcattttttttttttttaaatcctgggccatttaaacaaaggggggaagtaaagcaggtttctccagagatgctggaaaaagggacgagaaaccaaagctgatggcggtggatggatgaagtcccagccaccctccgtggaagggtgcagatctcctttaagacctctttggtgaagagtcagctgaaggtcctccccagcataaggcccagagatccagctgctgctgtgggaggctcagcctgggctcctcatcagtccactggtctcagagggtcatcagcgggaagtgatgagcatcttggaggtcaggccggatgtggcgaacacccactggtggtcaggctgtggtatgtcagggaagaggatgttcctctaacagcctaaaccaacccatggaggaagtttgggaagtcatggattattgtgtgttggttttggtttggacccattaggggcactggcttttagacaacaagtatgggggcgggggaagtgtgttgcatggaggagctttcaaaaggtaataggtaagagtagccctgggccacagcccagaagtcttgaatcatggaaccaagactggaagctaaatttcagcagaaattgtatttgccttgtttactgtgatggctcagtgcttagcacagagcctaccatatggcaggtgctcaataaatgagttaatcaacaaaaagagcatcatcatagtggctacgttctaaggatgtggtgaagattcagtgagatactgggtatcaggtgttcagcaccatggctgcacgtggtcactaccgctagtacaactaaagtcaaacactagtgcaggggtcaggaaatattttctgtaaagggccagatagtacatattttggactttgcaggccatacacttctgtgacatttatggaactttcctgttctagtgtgtaagcaaccatagaaagtaaataaataaattgatgttgctatattccaataaaactttatttataaaaacagactgtgggctgaatttggcctgtggaccatagttgcctgacttctgccttagaaaatgacaaagtcaagggatctgttcttcacagagagggtacaaatgcaaatatgcctagattcaggggaagttcatggatatccatgaggaatagctccagcccgagtaaaccaggtaaatgcaaacacaactaacatagcccctcacctgggagactgatgacaagaaggatgcaaagagcatctgctagcctcctccccacagcttctgagtgccagaaacagaatctacacatacttagttttcactaacccacatcggtttctatgagtgagtagcattcttcttcatgtgtacagaacagcagaagatggaataattagaagcatgtatttatccctgaggttccctcatttgtatattcacatccctgatgatgtttaagacctcaggtcactctagtgaaaattgaaagttgggaggctttgaaataagagtaggcccattagtcactcaacaaaccttgtctcctatctactaggtgctaggcattgtgcctagtggtggaaatatatggttatgatcttatcccagacttggatgagctcttggtctagttgaggaggcagggatgaacagagaattaattgtaacaccatgcaactaatgaggcagtaggtgttacttacatttacatggcagggagtggccatctgggctcagggtgagaatgtgtaagggaccgtttcccaggaggtgatctttgagccccgtaatggagtctcactgcactcatgtacacatactgcttttagaattgatttgttttttctttgcaggaaggatgcaccctaaaaaaatgttgagaaaacagtctaacctagttctcccactaggacattttggaggtaaaggagaaatgccagagaaatgcctctactctggattacacagttggtctgtctctactcaggccttgatgtgaaaaggcagggacagtgaaacactgcgagtagaaaccaactgtcctcttgactcataacttttatattgacttgtaagtcagttcttccatggtggaaaagtaatacagacgttgggcaaaatatgtaatgggatttaaattgtagccttaaaggtagcttaaatgttccatagaaaatgctccaggataggaaaaaaggatcttgtgatcgaaggtttatatttataaaatttgtccttttacaacaaaggataaacagtattttctaagttttttttttcatctgcttccctggttcccccttcaggcccactttaacctcaccattcttgataactattttcaacctaaatatgaacaagtcactccttggcttaacaccatcagtgggagccttttgtccacaggacaaatcctcactcaaggtgctttgttctgtttcttctgcagctccagccacatcaacctaataataacaggcaccagcccatgaattctaccatgggtcatatttctcttggctatttgcttatgtgaccatttgatccctgccataatcctaggcagctgttttataaaggaggaagctgagattcagggagatgcagtaacttgcccaagatcaagcaagttttcgtggaatttaatcaaaggtctacctgaattgaacttctgggactcttctacaatattcttctgcctagaacattcttcatctcatttttttttcctacaaaatcgggcccctttagggtttggttcagacattccttcaactatgagccattctcagtctctcataccttccttttgactttcaataccattttgttgagggggcaggtaatcctcacaacactggcaccattgtattattccaatttctttgcctttctcttccatgtgatacattgggagcatcctgaaagcaacttcattatgtaatctatttttatatgctcaggcctagaatggagacagaactttgaatatgtatcaaatgactatatgactaaaaaataatattctaggatatgtgtatttgggccatacctctcaaatgcagaaataacaacctttaaaactgtgtgctgatggagactggatgctgcatgtagaatgaatgagtattcttttcttgttatgctctttgagtggtgactggagcgaccgactggttggggctggttgtcctgtccagcatctcagaaatctctgaaatccatcctaaatgtctaaatgaagtaaagtggttggctttataagtaatagaagtcaattgtgtttgcagtctctaatgcaagaacggcattagatgactgagatggggctagtgccaagaagtgctgagtgggcaggaggcctgattttcagcctccctctgcatccatttgtgataatctgagtctggcgctcaaccagtcatcctcctaacgaggcttgcatgagacagcctttgcccccagcacagacatatactgaatcaggagttcccttatacagacatttaaaaacacccacacatatgcacacactcactcacattctttccaaatacacattttatcttccttgttacaaacattgtcctaacaggctggcaaacattcagacagaaactgaaatatttagatgaactggggcaccttaactcctctggaaaatgacttttagctgaaaggcagaaggaagctgatattctgccttgatcctgtgactctgagtcattgatgaacgcttgccttttggcttgagggtagggcatgagagctgcaagcaaagattgaaataacactcatgtttgttctacattttacaggggagctggtattgtctcccagcaggaaattagatgatattcactcctaggataataataaggaagacattaacaataaagatgaacatttatttcccaccacattattctaagcattgacagcattaggtgatatacccataatgatcatctgaacatataggtgcttttattatctccatttcacaaaatggagaagccgaggcttagaggggttcacaatttgctcaagatcacacagtcagtaaggagcccagcctgaagtagcatatatatatatatatatatctatatatatatatagatatatatatatatatatctctccacagaacctgtgtattttttttccgtgctcatcacccaggctggagtgcagtggcacgatcttggctcactgcaacctccacgtcctgggtacaagcgattctcctgcgtcagcctcctgagtagctgggactacaggtgtataacaccacactgggctaatttttgtatttttagtagagacggggcttcaccatgttggctagactggtctcaaactcctgacctcaggtgatctgcccgccttggcctcccggagtgttgggattacaggcgtgagccaccgtgcccagccctgggttcttaaatgctctgttttacagagcagggaagctggcctgctcaaatttatttgaacgagattgtgagaaaccatctgagagtgaactcattccatggaaacaggatgtcaggattgtcaagctttgccctacaaaacccttagcagtttcaagtagggggattatttgagggtgcatcctggtgttggaatgttagatgagccttttggattatctttctataatcttatgctgggaacctatgaatgccacaatgacaagtatgactagaaagaattcatactagaggccgggtgcggtggctcacgcctgtaatcccagccctttgggaggccgaggcaggcggatcacaaagtcaggagatcgagaccatcctggctaacatggtgaaaccccgtcctactaaaaatacaaaacattagccgggcgtggtggcaggcacatgtagtcccagctactcgggaggctgaggcaggagaatggcatgaacccgggaggcggagcttgcagtgagccgagattgcaccactgcactccagcctgggcaacagagcaagactccgtctcaaaaaaaaaaagaattcatactagaaaatgtcaggagacatacaggatgctggcaaggctactgtgggggctctgctcccctgaaagaagttgacaataaaaagaggggagggaagggagtcatcctagaacagtctgcccatagccagacatatttatgaagccatcctagatcaaccagctcctggcctgtccccaagctaagtctagactggaaggatggcgcagccaaaccaccaagttatttataaaatcactgttttaagacagtaagtttttgtaatggtatgttacatagcaaaagttaaccgatacatctcttattgcaactctacagaattaaaaaggacaagtattataaatcagaagagggaattgaatatctcagaggattcagtgactttcctaaggtgctaaggccaattaatggcagaataatgactagcagctagggcaattcacaagaagtcttgcaaataaaggaaggtagcgtgtactactccaaaacatggtctgaatcattatcatccctatccttgttttaaacttctgtggaggaaaaagtagccccaccttccagaaaacacaatgtaaatataactgccatcattgccatcttcataactagggaagccataggatttgccctacaaattggactctttgagaataacagggatgctactaataactatgccaaaaatatttatttcccaccacattattctaagcactgacaacattaggtgatatacccataatgatcatctgaacatataagtgcttttattatctccatttcacagaatggagaagatgaggcttatttaagcaagctggctctatggccaccctatctctaactaatatggagagagcactttatgggttacaaacccttttaagataattatatttcattttacaaaaaaaatccttcattgtaatcacaacaccctcattttgctgaaggaaactcttattttcagagaaatgaagtaacttttctatggttcttgacagtaggtaggcatttaataaatgtttatgtttattaaactggatgaatagcagttcagtgggtggatgaatgcatgcatatgtaagaataaatgcaagaaaaggaagcagaaagcctgaccacatggtgttttcaagaaggtgtaaagagaagacagtaagtagctaaatggatgactctcacactgagttccccagaacatcaatgccctccatgacattagtaggtgttctgggaccatcatgtaagcccaaggtcttatgttcagtttgctcatctataaaacgggagtaaactttcatgaaatagaggtggaaggacaacagataatgcaaataatgtgtttagcacagtgagtagtacactaaataagaagacaaataacagcaaatatgtactaatcatttatgttccaggcatcatgcaaatgcagtgtgtggattaacctcattttctcctctgtgtctctctctaagtcaggtaccatttattatccccacttcatggatgaagaaattggggcttacagaggaaagattttgcctaaagtcacacaagagccaatggcaaggtgacccagaccctgggttgccagttacactgctgacctgtctcctgcccagtgaatgacacctgtccttagttttattactatgctttgttaaggaaacactcctcactgtatccacagcactttaaatttggatgggtctcaacccttttcagtcatgtgacccttaacaaaatcaaaactaaatcacatttgagaagcctaaaatgtaaaacaaagtaaaaccagaattgctgtgattgaaccagttacagagccctagagccccccttcctgtgacaactgcataaaaacctttgccctctgtggagcacagtaggaaaatattggtctgaagcatagttgagtggatttgctgcctggcacatctaggcttactgtctccggggaccatagcctgctggttccctacaggatctgaatgcatgtttaagctcagataaagagacccaggaggatcatgagggttgggacaggattgaatagagcagtcatctttctgagcttttttaggtaagacccaggcaatagcctaggctatggtggggttcctggagagtctgtaagaaagatttccaagaaaactcattcttatgaagccaggatttctaaagatagtgctggctcaatggcaatgaggaatgacctcctcttccctcctctccccccaactccaattaagtcattttctttctctccacctgtacctggggttctctccagactgcaggcaaatggtgcattaatcacacagatcagccagtgcacaaggatggtgggaagtggctgatttatgaaccagcccaaagtgtggggaggctgggagtgggtgaggtgggcccagctcggggagcatatgggggctccttctctaggaccagacccatatgctccgctgcaggtccatatgctgtgtgggctggtcccccctttgccaatgtcgaggctgcctgtctgctgtaacgtgcagggagctagatctgccacatgccctgctggcattcaaacacaccctttccaactgtgtgagacatgggggctcttcttatagacaagaagagagctacacttatgcccttgtcaatatgagttattgtcatcaatcttttagaaacagtccacaagaaatgagcaagaccagtttttttttctatttgttagaaaagggaattgagacataatgctagaatcaccaacactatgactggcaataataataaccaacaactattgcatgtacatcaggtcctgagctccattctgatcagtttttacacatattaattaaagacacagagtggttgcccaaggtcatggtttgagcgttagagttacgagttgtattcagatctatgtttgctgccacttcctttaaattgtcattcataatttagtctttccctcactcaatgagcatttatggagcctctaccaccgttagaccctataaaaagggcttaggataccactaagaataaagcagatatgatgccatctctcttgggagacacattttagtggagcaagacagacaacagcaaacatttttaaaaaagttaaacaagaaaatgtgtagttacaaattgcactaacttaaatgaaggaagtaaacaaagggcttggacaagaatggcagggtacctagaacagccagggcagtcagaaaagcatgaagccttcagggtgagagggagctgctggaggggaaaggagctccaggctaagaggttaatgtgtgcaaaggcccggaggagtgaaggagccccagtgctctagggacaagtgcaggagggacagaactaacaagggacagcagagagtggtaaaagatgggatggaaggggaggtttcaggcagatcatgaagggattatatatgcactgggaagttgcttcagagttttcagtagctttgcagtactcacttatagttaatattggtgagtaacagcttagcttgctcattaataatgtgacatcccccagctccctagccgatcccctagggcctttcccatccccagatattttgtagtggcagaagccaactcaagaaacagttatttggataaagatgtgtgctcaactggtctgtatatacctccaagggcaggtattatacttaatgcctagcaatatatgggaaaatatagtagaattcacaggatgtgggtacatttttcaatttaaaaactattactgaatctttaagaccatgtttgctttttagtaagctctaaaataatatcattactctaccccattaagttttactacactaggttagcattctatttttttcctttgtacattttttttctttgaagatatcaatagctttggaatgttttattgttttatcatttctatctttttttaactttccgtcgcagcaagcctgacctcagggaaaagatctattagactgccaagattaaattttatttaaccaacatgtatatagagatcattctgtgttccttatgatctaaatgccttacaggaataaacacatttaaccctataacaagcccataagatcgatactgttattatcacccccattttgcagatgaagaagctgaagcacaaagagattaagtaaaacagcccaagttcctattgccaggaagtggtagagctgggtttgagccctggaagtctgtcccctgtgtctctgctattagtcatttccatccgatggaaatttccttgtgtagaaactgtgcttacaggccataatttttaaccctattgtgcttcgtatgtttcccttgcccactaaagaggattctgacttgacatgtggatcttccctcatcctctgagctctcaggagcctcctgtcaagcagggcagggtttggggtttgttacttagtgtcaggagaaaagggcaaaaggaaaaggtagagtgtggggaggagattgtcagggattgaggagattgcttagagagacagactgcagctgccatgtgtgaggtctgaggatctgtgagactcaaagggaaattttaagaagcattgcggagaagagaaacttcttttgctgacaagtgtgagaagtaaaggcaaaaaggctttcacagttctgaacactgttttattgttatcctgcattctgcaatggatatcactccatgctgagcctggtgagccacatgttacaacagcaaggcagctaaaaacaatgcaattttattttcattttctttctgccctctttctttctctttttctctagctttcccttcctcctttcctctttctctttccctccctccatcctttttcccttccttcctttcaggatccatttttggagcacccattctgtgccagatcttgttcacaccctctgaccttcagaagctcagtcttaatatcatcgaggaaaacatttagactacatacacgtctccggtaatgtgaggacatttgatctcctgcagtcccctggagagctgctactcttttacttggtctatgagcaaagcttgcactttgtcatgcctacgatttgagaatgtgaattcttccacatggcatctctcctataggttctcattcactccttctgaaggcttgggtaaaagacaaattgagaaactgtttcacagtttgcagacttcttaaatatttgtctgtgagtgctgttggacttagtataacaggatttagcaaactcttttctgtaaagaaccagctattaaatattttaggctttgtaggtcattcagtctctgtcacaatatctccactttgctgttgtagtgtgaaagtagctttatacaatatgtaaacaaatgtgcatgactgctttctgaaaaacttcatttacagaagctggcagcaggtggatttggtctgtgggctatagactgctgatccctgtagagaaatttggattcttccgtgcatagacactatcccttgtggatgttctgatccaaccagaggatccctaagtgactgccgggcttgtgcaatgaggtggtggtgtctttaagcttcccaccggcaggccttttcaggtgtttatggtcaggtgataggagacgttgctccaatcagaactggaacacagttgccctaatcttcatgggcatccagtttatgaagggagccaaggaaagtgtgatatttaaaaagggattttggggacgatgctgggtgtgaacacacacctatgtacaaacaatttttcaacatgtttgatgttttgtgtgtcatgagtgggtaaatctatggtgatggtggtgttggctgatccattttcacttgtttacttgatggggacagagaaggagaggtgaaaatgggggcatcccagggaccagagccaaataagatggatgggtggttattcaagatgcaggaaggtgactgctacatctctcctgggaacatagaaaccttactaagagaaatgcatcctgcaaggatagccacaaagggatagcctgtgctgaatctagatgcttttatttaatgcctatgaatgcttttagatggaacatgtatttctagatctccaaattctctccattctcttatgattcatccctgtggtgtttgagtttgcactctgtgaagaccttctttgccacttcctgcacactctttctccagtgtgctttcccttcaaacagccacacctgcaggtgtttcccaaaggaacgcctttgatctatggaaccctatgcccacattgagatgagtgagaagtgccttggaattcacaccctccagggtggcccttaaccaatgactaaggggatgtaggagtttaaaagcttccttgtgtggggtgtggatgatgatgacaactactggggtaacttaccctccagagttccctgtgggtcaggctgctggacttggcatgataatgtactcctgtctgactttgctcacaacccctcttttctttcctccttccctcttccctgcccagtttctcctgggagcatgtccttcataaatcacttgtgcacaaatcctcatttcaggggacagtaatttgaatagtgaggtgcgtgcaagtagtttatctatgcctcctgggtaaggtattcggtgcctagcaccatattggaaactcagtaggatttgtaagatctggctacatctttaaattctaaatccactactgagtctttaagaccatgtttgccttttatagtaagctctaaaatgatttcattactccaccccattaagttttgagacctgtcccaagactcattccctgaagaaaaatataaagagctgctaaggagaggtagaagccaggcagatacttgggccaaaaaatgaaatggttcattgattacaggaaaggaaagaggaaaacaacttaatttagattgaaactcctctcccatttttttctccatgtattagagttaatgaatttgtgaaataagaaagagtggatgaggggaatgctattcaaatgcctgcaaattaatcttcctggattcttcctgcttcagcctccctatcttctccttcaggctgagagctcagaggtggtgggcacatggtgccacccacaagttatcatttgctagctagtatcacaaactagtaaatgttgtatcaccctccctttttctcttttgggtattttttttctgttctcctcactatgaaacatcatattcaggagaagaaagagagagtttatagagtttaatactgattcaaaaagtcactgaaaatcccatttagttatagagagtgatataaaaatatagataaatatgtatttatatttttaaaatggtattttattgatatgtagcatgtgtttcactgggccaatgatattatatttatttatacttttatatatttaaggtgcacaatgtgatgttttgatatatatatatatacacatatggtaaaatgattgctagagtcaagcaaactgacatatccatgtatccatcacctcacatagctaagttctggtgtgtataggaagagtacctaaaatctaccctcttagctaattttcagtatacagtatgatattattaacaaaatctgcatgctatatgttacatctgtagacttaatcattctacatcactgcaaatttggactctttgactcatatctccccattttctcctcctccctgcccctggtaaccgtcattctagtctctgtttctatgtattctcaatttctatgtattcaactttttttagattccacataagtgagatcatgcagtctttctgtgcccggcctgtatcactcagcctatttctctccaggctcatttgtgtggtttgcaagtggcagtatctccctttttataagccaaataaaattttattatatatatgaagattatacacacatacacacattttctttgttgattcaaacacaggttaatttgtttattgggttgtttccacatcttagctattgtgaataatgctgcaataaacataggaacaaagatatctacaaggtgccaatttcgtttcctttgggtatatgcccattggaaggattgctggtcatacggtagtacaagttttaattttttgaggaacctccatactgttttccataatgactgtactaatttacattcccaccagcagtttgaaaagatcctcttctctctacatccttgctaacacttgttttctcttatcttcttgataagaagccatcctagcaggtggcttctcattgtggctttgacttgcatttccctgatgattagtgatgctgagtacattttcatacatctattggccattttcatgtgtgtgtttttttttttttttggaaagtgcctgttcagatcctttgctcatttttaaataaggttatttgttttttgcttttgagctgtgtgacagtggagtcaatgatacttgtgtgtataaaaaggttctgtaatgctgacctggcttatacaatttaaagagaatttctagaatcacattttgatgaattctttattccccaatagtcctaatcttaaaaaagttgccatgaaaggggtagcaatactcagtgtggcacaggagctggcttataccagctcacaagagcctattgttaacttttcaggaattacgcaaactcgtcagtgttacattggtggcttgaaaatggctgtgttggaaatatttacaccatgaacattgacaaaagctttaaatcatgccacacctttcccactccttcccaggagatctgactgtcaaatgtttaccagaacaccactggtagtgcctggacctttcctctgcccacatgtggtgacctttcctctgccatgcctgtggactggctgggttaacagtggggtgtctaggtaagcgtctggatcaggattgttgcaaagggctccttgctttctctccattgtgatctgcataacattcatgaaagtctttcctcctgccagcaggtctgttcttgcattagaaaaggttgtgttcagttatctttctgcacttggaaatacatattttgtgagataaatgaagaaatatttgcagctggtatacttttcctcccaggatatttgaatattttgaagctatggtctcattttgctgagaagagaaagaaagtcagcctgattcctggcttgtatatgagtgctagaactcatgatcatgatggacagacttaaacatgttctttctgccagagcatgaacctcattctatgatgagaataataggggtggttttgaattaggctgttatgagtgagcctatgaatatatgtgaatgcagctaagtagctttaatattcattcattcaacagacatcagcttcatagtgtagattcacagcccagcagggaagagctaggatgtatatgcctattgtctgaatggtacatggcgtgatagaatggagttgaggttttaagtcaagcagacctgtgtgtgaatcttagctctgtaattctctagctgtgtgaacttaaccaagccatttaacttcaattttgtcataagtaggatgacaataataatactcacttttccaagaaaaaaaaaaacaggagcttcctaggcaaagtgggatgaactcatccacaaacaaggaacagcttatacaaaggtgtggaagaatgcaatgtgacaggaatattaaaactggcaactagttaggagacagaatatctgatgttattttttctttaaaaaataaatgacttctggccgggcgcggtggctctcgcctgtaatcccagccctttgggaggccgaggtgggcggatcacgaggccaggagatcgagaccatcctggctaacatggtgaaacccagtttctactaaaaatacaaaaaattggcctgtcgtggtggcggatgcctgtagtcccagctactcgggaggctgaggcaggagaatggcttgaacctgggaggcagagcttgcagtgagccgagatcgcaccactgcactccagcctgggcaacagagcgagactccgtctaaataaataaataaataaacaaataatttctctgtgcttcctgaatcttaaggccacaggctgagaagagccagattttaatttctctaactgtaaatgcttagactttttcctcacccactcaggcttaagccttttgtgcaaagggaaggtggcatccaccattctctcaaagtttgctccacatccactcctttaaggtataggcataagaatgagtaaatgccaagagaacactggatccttccttctcttgggcaaatggtaatgctcccagaggcagaaatgggccttgctttgcattccagacttgccctctgtgaacaggctttgcataaagtgaatgcaatgatagaagattacagacctgcagccagaggtagaagatcaggaggggactggattattggagagctgttctcaagttcagggactggggtccagaatctccagtggctggagggataggcctctgtgtttattcaaaagctccctgggagattcagacacatcctttcactccccacctctctaggtcccttttcttgttcactgaacgcactgatgtggagtgtactgcagggaaaccttgtgctgtagtatttgggaatgctgtcttgaaggggcaaacctggggttcttctttagactttttattcactattctaaacgtgatccgttctcccaaatgtaatattttcccccgagaataaaaacactgaagaagtacgcaaaataaatgtgtccctcccctgaaaattgcctcattgttgagttctttttccttttacaaattctgtatttgctgagcaacagaattacaatgacaataacaaaacccccaaataaagctgtttccatttttcatatttaccgcaggccttgtccatatgtagacataatttttccagtgttactcatagtgtcatataattttatattttgcttgattcacttaacattatattataaacaaatgttgagtttctttgtcgtattcctaacagacattttgactggctgcatactattccatcaagtggatgtaattttatttacttaaccatttctctattattaggtatttatggtatttacaattgtttttaataatacattaaactatcacagaaataaacatcttctgtaatcccagcactttgggaggctgaggtgggcagatcttgaggtcaggagttcaagaccagcctggcctacatggtgaaaccccatctatactaaaaatacaaaaattagctgggcgtggtggcacgtgcctgtaatcccagctactcaggaggctgaggcaggagaattgcttgaacccgggagatagagattgcagtgagctgagatctcaccattgcactccagcctgggtaacaagagcaaaacttcgtctagaaaagaaaaaaaaaaagaaaataaataaacatcttcaacatggcacttttataattttttgtcttgttttaaaatgattatattgagtacaattttcataggtggcaaaatgacctaaaaacatttccaggtacaagtttacagggcaaccagctttcaaacagagatgtttaccagctttgtcaagatattcatcccttttggatttttgctcatgtcaagagatgttattgctaactgcaattgaactagaaaggagatcacagggcaatggaaaacatgctgggccaggcatttaaacacatatagcaaactctcccctgcagaacagaggtgtggcactcgttatagatatccatttaatggatatgacaatttgaacgtagctttgggaaaatcaagagaagccattagggtccattcctgaggaagcagcccgaatgtctatatttgggaggtctgtgaagctctctagagtgtaacaatcacagcactcctatgttgtccagatagaacacaaaggaggtcacaggaggcaatgcacaatgggaaggcaccccagaactgaaaagggactggcaggcctaagaagggagtttcaggctagcaattggggtagcacctctcctatgggaccaggcaagaacaggtaaaaactgcagccatccctgatcctccagctgtactgactcctttgtacatcaacccttcagtgcagatcagaaaaatgattccctccaaacctggttaggttaggaaggagctgctaatttttttgctggcttgtgatctcagtccttctggtcctgtgagaatttgagtgcaaatggctgaactcttataagtctggggctggttttataattatagctcatcttgtgtgtatcttaccttcctctttctcttgcacctgcttcttcctcattgtctattaatttgcttatgcttctctaaccctgcaagattaaaaaaatgaccttacttctctgtttctttgcctttagcttcaaaaatgtcaacatttagatttttttttctatttgtgttccatgagatactgtgcaaaaatgaacaattaaaatgccttctgacagagttgcctaattagatagtagataaagtgtgcaaattctatttctcatagcagagatctcagatgatctttttctttcctctcttctctcccatgtcagaagggtttaatatattgttttctctcttctctttctgaccctatagtggctttcttccaagcagaatagcaccacatgagtgccttgttacagtggacaggaacatgcattatttacaaactctatgctgctcccacaagcagcagttctcaaaagaatttacatttatttcaaactattttgtgaatcaatagaacatatttccttctgatcttttagcaaatttagctgaatgaaacattttaaaaatagagtggtttccaccagggcctgtcggggagtggggggctaggggagggatagcattaggagaaatacctaatgtagatgacgggttgatgggtgcagcaaaccaccaaggcaggtgtatacctatgtgacaaacctgctcattctgcacatgtatcccagaacttaaagtataataaaaaaattaaaaaaaaattagagtggtttcttcacacctatgcataaagataggaattttttcagaaaaatttcagctttgtcattatttaaaatttgtttcaagttgccatttcacttttgaaaatatttacattttgaaaaattgcaaaaatggtagagtttctgtatacccttcactcagctactcttcatgttgatatcttgagtaaccatagtacaataaatcaaaaccggaaaaataacttggtacaatactataatactgtcttctatggtttggtttgtccctgtcaaagcttaaaaattgaccaaaattgaaagttgatgcccaatatggcagcattggagggtggggcctaatgagaggtatttgggtcatgagggtagatccctcaaggatagattaatggcctacaacctgggtgaatgagttctcactcttgcagaagtgagttagttcctgagagtgcaggttgtaaaaacagcctggcttcctcagttttgctctcttgcttcctctctcactgtgtggcctctgcacacatccactctccttctgctttccaccttgagtggaagcagcttgaggcacctgcccagatgcagctgttcaatcctggacttttcacccacaagaatcaagtgttgaataaacctcttctctttataaatgacccagtcttaggtattctgttatagcaaaacaagacagattaagacactgttcctatagtacaataattgtattgtattgtaaagtaactaaactacagaccttatttgaatttcagcagtttttctacttatgttctttatctattccaggatcccatccaggaccccacattgcttttacttgttgtgtccctttggtcttctctgatctttaatgatttcttagtctttccttgtcttcatgacctgacacttttgaaacgtattggttggttattttgtagaatgcccttcagcttgggtttatctgattttcccccttcctgattagattgaggttaggcattttcggcatgcataccacagaagttctggccctttttgtatcaggaggtgcataacgttaacatagcctatcactggtgatgttgactttggaccacttggtgaagatgatgaccaactactatgtttctacaatagtatttttatctgtttaattaataaacatcttggggagaagggaagaaccctgtttaatttcgtttttattaatattaaattctttcctttgcctgtttttccttttcttttcttcttttttttttttttttgagatggagtctcactctgtctcccaggctgaaatgcagtggcacgatctccactcactgcaagctccgccttccgggttcatgccattctcctgcctcagcctcccgagtagctgggactacaggcgtgtgccaccatgcctggctaattttttgtatttttagtagagacagggtttcaccgtgttagccaggatggtcttgatctcttgacttcatgatctgcctgcctcggcctctcaaagtgctgggattacaggcgtgagccaccgcgcccggccatcctttgcctgtttttcttatcttctgaatcttattgatgtccatttgatggtttgaaaatttaagagataggagcatatttagttactatttggaaagttttcatggatgaggacacagtccataggggatatgtgaaaattgggggtaaggacacccaaaggcaccccttgggagcattctggaagaagtcttggaatgaggaagccaaactttgtttctacagaaattcttaacctctctaagcatcaatttccttgagtgtaaaatagggataataatgtccctgcagaggtatggtaaagattaacatcaagtactccctggatgtttcctggtacaatacctggtgcaaagtcagtctcattacatagtaattcccctgactccagggagtcatgtgctcaaataccaacccctactctctaattctgttgtgcatgggaattctttgcttctgtaggcctcttgccagttcatagacctaaactgtgaactacacagagaggaaattgtagtctgcctcctgcagcatgcagccctgactcaaacttgttttaaattcacattggtgaaaaatgggcttgcatcccactgtgaatttaaatacttacaacccaggaagaaacggatcgcatggctcatttatcttgcagccattaattaatggtggttaattgtagttatgagctgttgaattccaggctcttgcacccacacattttctttaatgtgttcagaaaaccatggaggcagtgagttggggactgaaagaaagactgtcccagagaggataggctcacaaccccacccctgctcacttgtttgttaagagagggcctactgctgcaccaaccttctaggcagggggctgtgatcccacaacacactgctttctgggccacttccccacatatttattgtcccctaagttcctgggagggatcttcttagacaaaccctctttgtatttcttctgcaaatgagaagtaaattaacttgcaacaaagaggaaagaactttaataaatctggcagcttgaaagagattgtgatatgaagaatcaggacttgggcaagaatgaaaattatgtttttgaatatttctgttgtactctctggggagaagactgctaaggggtgggacataacctgggacaagatgaatatggatgtttcagaagagaagagcccttgtgaccaccttttagacttcatcagatgaaacttctgtagacatctctgacctcacagctcaggagttatcactggatttatgaatgcgataggcacaattctaagatggttcccatgattcctatcttttggggtgtaggccctgtacaattctctccccttgagtgtggtgggcctcatcaagttaagtgaaccctttttaaaaagggtctagagctccaagacaaaatcatagagatttgaaactacagcaaatgctccccttgttggccttggagaaagaagtgaccaaattgtggagacagagatgtgaccagaacttgcaggtgtcccctaggagctgaaatggtctccagctgggtgctggcaagaagacacctcagtcctacaaccataatgaagtgaattcttccaatgacctgagggagcttggaagtccagctgtacctccagatgaggatgcagcatgctggcaccttgacctccagccttgtgagcctctgagcagaggactcaaccaaaatgtgccaagctattcatgaaaattataaaatgataaatttgtgttattctaagctactaagtttgcagtaatttgttatattgcaataaataacaaatacatggaatttatttcctcatctcacctgggctattatcagtctttatttttttccatttgtgtctttcctccttcacagcacagagcttgtgaagatagatttgtcttcttaaagaccttgaattatattatctcatgctttaaaattgtcagtggcttcacaatgtctacagcaaaaagcaagtcctggttaatctgaatttcatggttcctaagtgcctttgagcctaatttcacactgggtcagttctctcatcctacattccagcctaaagaaactgctcatggccaccttccacaatttctgctcacactgtgcctttgcctatgctaatttctctgctgagtgctttgattcccaaggccatgtactcaactccctattcttcaagtcctagctcccccttggctactgtcacgtatcactcgccctttgaacctcccagcaccacattatacccccagtagttcggactaatatcttcatagtttgtgatctttttgttatgcagaaaattctgtgaataaatgagggtttaactaaccaggctctgtcctcaagatgatcacagttagttcctttttccttttcttttctttcttttttttttttttttttatttgagacagatctctttctgtcacccaggctggagtgcagtggcaggatcttggctcactgcaactctgcctcctgggttcaagcaattctcctgcctcagcctcctgagtagctggaattataggtatgcgccaccacgcctggctagtttttttatttttagtagagacaaggtttcaccatgttagccagactggtctcaaactcctgatctcagatgataggtctttaagaggctcagattatgcattcctccaacatgtaaaagctcatttttgcctcaaggactttgcagcttcgattccctctgcctggaatgtctttacctaagattctcacatggttggtgccttcttatcacttagcacctaaaaatattgttctcctaggaggccttctctgggcactctatggaaggcagcctatccttcccatcacctatccaattgctctgctttattaacttcaaagcagttattgctatttgaaattatctcacttactgatatgtggtttgttcatttcctgttttctcttgatggtcagcaactttcttatcttgctctctgttttatctacagtatctggattattgtagtctctcattcaaaaattgttgaatgaatgaattcaaaaacatgtcacataacaaatattctgtgtcctctcagtttttttctgcttaagttcaatttgtaattcttcatccttaatccatcatagtgagttctcacccacagaagacacatattttgggagattatgtaacatttaataatttaataagacattcataatgtaattattatctttgtggaatgtctcctacagtttgcatccatgtgcacattgtagtggatactgtcatatgctgcctagcttgctccttcacagatgaaacattcagattcctagctgctgaagattcgttgctgatgcctcatagatgattccttcttagggaatttcctttggccaaaggtagttgccttgctctaggaagggacatttacatccaataacttgtcaatgtggaggtacaaagatcttgcctaaataggaaacaattctaaaagtccatcccagctccagaggtccctgtgaaaagtcagctgaggactttactgtaactgtaccatgatctaatccaccttttccttctgcccaattctgcttcttacattctccaaacaatgttgttcctaagggcacttcctaatctgcatgcaaatcctcatctcaaagtcgatttcccagttaacccaacctaagacagttggggccagaaatggctaaggaagaagactctgaaatgggattttggagctggattacccactagccaaccatcaacatcagtgaggtaggggaagtaccgactatccctagaaagaaatagtggtgcgagagttaaaatgtgccagtgaagaactgtgatgtgatactggtagacgataaaacactggtgaatgcaacacctccggattttaagacattcaagggatgcaataatttataaggacaatggaataggatgactgttgctgcggcaatcagtgcattaaaaagagactttaaatgcctgagtgtgactagtcgccaatataacatgaagtgcaaaagtcagagggcctccttggcacacatgaaataaacctctcagctcctacagcttgtaggcagaaaaggctgaaaatcaggtccagaatattagggttgtagatcttcaaagaaggctaaattctcaaccctagcatatttaccatgccaagttaggaccctggtttgttttaatttttggtgttgatgtttgtttttaacaacatcattgggatcttgagacttgaaataagaacaactgagttgacacacttgaaaacctaaaaactccagacctactggaacccactggcctcacagaagtgctctacttctccttcttgaaatctagtgcttccctatgcttgaagatgattcagaggcctttttgtcttgcaagataacatacaccacctacagaatctacccccaccactttttcttgctatcacatgagtaactatgttcaaattacaactgaacagggaaattctgatcctgctaagggagggaatgtcaaaagggctacaggacccaaccaatgcttatcagcaggatcttagaagacatgcatgggactggatcctaagggtgctgcctcaagtaagggaaacataaagttgaatatgggagattttattgagatagagcacatgcctatgatacaggatttaacaccttaccaaggaccccaggagagggtcctaacacactgctgggatggttcttggaaacatggaaaaagccatggccattctaagtaaaccagagatgctagagctgccatgacaagtattcgaagaagaaagcaaaagatcatgctagagggagtatactaaataaggctggaaaactcatcagctaatcctgttccacgggaggatccaaaggacactccagttaccaaatcaataatgtatatgctggtgacaggagcaccagtgttgttgagaagaaacagaggtgggtgcaatgatcacaaagagtggcaaagttagagtggcagctggaggagcctggtttgcagagagttaggggatggttcatagaacaaggtgaccctaggggaaagattgatgggcagctaacaactctaatactcaacgtataaatcaagagatgtcaagaatagatggccaagaggctgagggcaacaattccaattaaaagttatgatcacttacctagtttctggaaatgaaccagttttagatgctaaacccactgatggaagccagtcctcagttggaagttctctgcaaccctatagcaagtatcagtagtgaagatgcctccagtgccttctcaaagggatctatgggtacttacatagattactgtgctctgggaagcaggggaacagagacatttgaaaggtactaggacacgggtggggcgcagtggctcacgcctgtaatcccagcactttgggaggctgaagaaggtgcatcacgaggtcaggagattgagaccatcctggctaacacagtgaaaccccgtctctactaaaaatacaaaaaatcagccaggcgtggtggcgggtgcctgtagccccagctactagggaggctgaggcaggagtatggcgtgaacccgggaggcagagcttgcagtgagccgtgatcgcgccactgcactacagactgggcgacagagcaagactctgctaaaagaaataaataaataaataaaaataaaaaaagatacttggacacagggtatgagttgacattgataccagagattcaaggcattattatggctctctgcctgtcacaagtagggcatatgagaatcaggtaataaataaagacctggccaacgtttatctcacagtgggtccatagtgaccatatacctatccagaggtcattcctgagattcctgcatatgtagctgagatggacatacttggtaagtggtggaactctgcattggtttctgggaagccacttaaacttccctcagccccttgatgaatataatacataaaggaacatattacattgtggcaggaatgacctatattaatgtcacccttttcttggtatccccaagcctctgaatcactcaaaggcttctcctaggctgtagccaggccaggggcacgagctctcatgcaatgcagactatgggccaggaaagcagcctgggacagtcaggtttctgggctttgcattgaatgaatcatattttccagtctttcaaggaatggtgcttgcaatgggaaccaacgtttctctcaactgactcttccactgacttcaagaatgcttgtcctgaatggggtgtgggaactgacccacaaaatccacctattttttttttttttccagatgagaagttgcattaggaatagggaagtgactttgaccagccagactccatctataaggacttgcagagtcaggcaggaattgacttcctctactatctcactctttccttgagtcatcactttccccccttcttttacttacacaaagctaaataggcacagtgactttactttaaacaagtcattcacccattattagacaatttttgtttgttttaattgttggtgttgatgtttgtttctaatccctttgaaacaaaagttcgcttctgtgagctcttatttcctccctggaaccctcattattttgttttctgttgtaaaacaaactaaggacttttaatctagacttcacagatgtttggtattgtcctgggtattttacatattcattttcatttacttctccccctagagttatgagtcagaaattacagccattttacaatgaaagacactgaagctcagagatggtaaggactttatatggagtcacacagcactctatagtggtgcagaactcaaagccacatctacctcatttcaggccttatccactgcctaccaccagccctgcttatcccatactcttctgtagattgaagagtccaacgacagagattacaccttacatatcttggaggtcctgctcactctacccctgccttgctgccaatagagagtctcatatatccaataaaagcttgttgaatggatgcctgcgtgaatgagttatgcaataaatccatgagtgtgtggtaacaaacttcaaagaagctgcacgattgaagtgagatatatctcacttgagcaaagagctcaagaaaaccaatctgaacaggttgggtcacagaaggcatcaaagctaaaatcaccagcagcaggagaatagaaaaagaaagctactgaaaaggaaacaaactgacaagaagttgaggggcagcttcttgaggggatagactgctatgctgcattcctaaggaatgctgagcattggccagtgaagagcaggcacatttccaggctgatgggaccacacaggcaaaggctaggagagagagggcagaagacaggaaacagatcgagaagcgtttagtgtggccagtgtgaagaatgctcagtggagagagaaaagaccaggctacggggcatggaaggttcagattttaccccaagggcaatggagcattattgaaggattttcaatgtggaaagcacctgagaatatatattttagttagatcatttaacttccatatgagtaagagattagattggggtaatattggagcatatgaccctggcctcaagaactagttgttctatactcagaccataatagacttgggtatttgcccacaggaagtgaaggtgaagtaggaggtgggacttgacgccagcagcagggctcagacagggaccaaattaaggactagctaaaacagggatggggcagaagtcactttccaaaagacacacccatcagcgtgccatgtcagtttaccattgccatggcaacacccaggagttcccgcccctttccatggcaatgacccaaggacccaaaagttatcacacatttcctagaaatttctgcataaattgcccgttaaactacacgtaactaaaagtaggtataacccccattttgggactcacctgccctgcatcaagggtacatgcacaaaaaatttcgcagagataattttaatagtgatagccccaaactgcaacatccatcctcagtagaatgaattcagttattgtccagatattgaaatgctatatagcaatgagaaagagggaactattgctacattcagttattgtccagatattgaaatgctatatagcaatgagaaagagggaactattgctacataccaccacatagctagatctccagacatgttgaaaacagcaaaccaccccaaaagagcatgcgattctgcttatgtgtaactcagaaagaggcaaaactaatccatggagattaatcagactacctgttgcctttaaggtggatattgaccgggaaaagacatgatgaaggtttttgggatctggtcatattcatagtctgatctctgtagtagttacatgggtgtaaaaatatgtaaaactttattaagatgtacattgaagatgtgtgtgctttattactgtatttgtgtaagtataaaatacttatccctttggaatttcctctataattactcttggatactatggcattgtagaaaacagtgaactatatcagtaaccaaaaaccatatagaattttcctgagtttgtgcttagtctatgtgtggtggtgctcagattaaaagcaaatttagcatttagtgggaactgaatcagaacgctaaatatatctgccagcttttgctatttcctcagaaaagctcactgtaatttgtgtgtgtgtgtgtgtgtgtgtgtgtgtatactacagctacatgtatggaacatcccctctgagttcttctcaaagttcctcagagggcaggacctttttgcagctgggcgtgcggtagataatagcccagtgcctgagtttctaagtgctgtgagggatgtcagagtctcaaccgagaattatttccttggtgtctcaccctgccctgcctggctcttcccactcagttcctggagggcttttttcagctcagtctgaaagagcacccagctccccagaggaggggcagcatcttgctgtgatgtgagtctaattgtttctagattgagcgtttccgtgggacaacagtcccagccggtgttccctgaattaacatgctcactgaaggattgaagatggtgattaggcccgacagcatcagtttcggtgggacagtcgcagtgccacagagctgcatgggaccgcaaggagatttatttgtgtggaatggagacatatggccggaatcatctgctccctttcctctgtaattaaaacatctgggagcagcaaagggctggaaaatgaggagaaagcagtgaacatctcttcctgctcagctttgaataatccagccatggggctggggcatcagggggtacaagccacctggtataggctggtccaggagttgcaatggcccaaaggccaggtaacttgtaaatgtgacttgggggttttgtttttggtgctttattttattttttcctgaaagcatgtagaattggtttctttctgaagctgtttctaaaatgttttacaaaaaaaaaaaaaaaggctaaatgacaacgaaagtgtagggctcattgttggagcctgatacaggctatgaccttcatctaagagctatacctccaatggatccaatcaagccagtatcaagacccttagcaaagacatcaagcttggaaggaatggtgcctaagggtgtcctttacttttcttagaaggactgggagtgacaatttagagagaaccttcttaggaagagtattgacactatagaccaattctttctctgttggttcactcattaacttacccaccttcccatctatcagcccacttattgctccctctacccattcattcaagcaatgagatttcactgaggttctgcacttggttctgggaaaacagtagtaagaaccctcatatagttcaccttgctttgaatgggacatttataaacgcacaaaaataatcccacatgacccctgctatgtagccaggtatttcatgtcttgtgagcatgcaagggagaagaccggctcctgcctgctccattctgctccttgaatccaataacatctgttgctcaagtctctgttccacacatcacataagagcccagtgccatcagtggaaaagtaaagaggcccgcatttattgagcacttactatgtgcctagcactttacatacttgaactctttgaagtgggcattattctgtccattacacaggtcagctaactgagattctaagtgagaaagggccaagttggcatttgggccttaagggtctaaattgaatgcacatatttttctattttatcgagctgcatgcttccagggcttcactattactgctaataaatactcagccttctgtgaatcctgtgacagttcagtgcctccctgcagtccttcttgcccaggatgttgactcagctatataaacctggtgttgcctcaaatccttttctaagaatccggattcctgcactctacccagcttatgctagccgctctacctgctaggtgggattcttttccatctgtctagactcccctagactgggagtaaatcaaagctatgggtcatgtctacttaatgtctttattatcaacattgagcacaggacttgacagacaatttccacacctgcaaaatggatccaattctaggatctgcttccttgacgttcttgtcaggattaaaggagaaagaatgtgtaagacacctgaaatagtacctgacctattttaagagtccagtgaatgttagctagcaccgttatcacagtttacatgcacaacgaccttgtgaagagaacggaggctcaactctatggggaagagaactgaggctaaagagactgagtgacctgtctgacaacacacagctaaaaagtcatagagctggggtctgaactcaggctgtctggctccagagtctgagttcataatgcatccacttctctgagtccttaacaaaaggtcatactgaatggtccacatatccagaatcacaagggtgtcatacacgtgactgagagtcaacggctttgtggattctccccaccatagccccttttcatcagtatatttatttattccacacatgttgtggggtccacccatttcaggaaatagaccagacagacaatgaaaggacagtagtcacagaacacgctctaagtctttatggagtttacagccttgtgcctgcttgaaatgagttctatttgtaccatgcctttgggcagcagcctgtagacaagggacattttctttattcactcccataaagccctggcagtctcctccaaagtaccactcttcaacacagctaaggtcccagcacctggtaagaggtaatctacctgctcatatgacagaggctcctgtttcaggaatcctaggaatagaccaagagagccctgctcgcatagagcaaaaagccgcacaatccatgttgagcctaaatttgtctccaagattcaattaagaccaatccagttcctgattaaagaatctgacatccatccaagcataaatatttatgcctgataggctttctccttaacagcaaaacaatctacagtgacaacattagaaatatgaatacattcctggtgatgactctattatcagcactaataataacttaacagtttcagcatgtggcatgctgagatgtatgcaaatggggggcacctctgtcagaagcacttgggagtggaccggagggtctgtcacatgccttagttgcagctggtgagacctcatttcgagtacaccggtgccttgtactcatttgccggtataacgctctgtgctcatgtatcactcttcactcaaagatcacaaatcagcttggcaggccctgctagtgcctccgtgaagccaaaacatctggataagaagtgaaaaaatccagtctttcagcaagtcagccagccagccatttttcagcacatatttgtttagtgcctactgtcttagtgggtgtttcatctacatgctgtcaaacatccagatgaaagacacattccttttcataattcatctagaaatttgggtaccagaaagatgcaatgcttttataacatctgcaacatctgttatttgtttaaatgttttggttttcttgtgggcactttttcttggaatcaggctaagtatgtgccagaaggttggagatatctggttctgtcctcatgtttctaacctccaggatttctgaaggtatagataacaggataacacctcatttttctgaattatgctccccaaactataaagattaaatataagttgagatttgtggataaatgacactgtgagcatgcatagctcatgacaatacccataaccctcttacttaactagcaggatacaacgacacattgtgtgtcagcaatggaaatgagggaaagatgctatttatatgtcagaattgtcaaagagttcctgacagatatagttcagaggagaatggattaaagaaggaaccacaggtaaggcaggaatttgcttaagaaggacctggaaaagaaactagcagaaaaacagtatcaatgaacagggatgattcgaagggaagaccacagatatttagggaggcacacccaggccccagcaatcccctgggtggtcatgccaaccactatatatttattcttggaaagggggctgggcagagtatgttgccaatcccagagctgacttccaattgtgtaactgtgcctgtcaaagagggtgggcattgtgtaattaactcttggctgctttcaaatggaagaggagaactgttcaccttgatggtgaaataaagaaatttgtctaacttgaacccccatttccacttgtaccaggctactggacttttgaactgacaatgttaaagaaaagtaaatctaaacatgaagaaagagagatacacactgtctttgccaaaatcgatctcaactccaatctggtacttgagatgagcaaagaggaaattctccaagcatataaaaagataaagaatgtcaaaagaagggggcccatttgaatcattagagcagatttcttcatgttaaacagttaaggaagagaaaagttctgaaaagttagtgtgcatccttaacattctagaagctagttttctgaaatgtgtgaggaagcaggaaataatataagacaagtaaaggctagaggtagatgaaaatataagatttctgactttaaaactgcaattgatcattaactagacaattaaatactcagagcattgtctaatataaatttctgcaatggtggcaatgttcctctatattaagggtcagcaaactttttctgtaaagggctcagtagtaaatatgctaggctttgagggccacatacagtcttatttttttaaacaaaccttgaaatatgtaaaaagaaatccttagcccatggacggtacaaaaacagtttgtggatatcacttaccacttatacgcctgctaggttggctataattttttaaaaaaggaaaatagagagttggtgagaatgtggagaaattggaactctcatacactactggtgagaatgtaaaatggcatgtcctttatggaaaatagtttggcagttcctccagaaattaacatagaattaccatgttacccagcaattctacgtgcaataggaatatgtgcaaaagaattgagaacagatgttcaaacaaaagcttgtccatgaatgttcacagtagcactgctcacaatagccaaaaggtgaagcaaacccgagtgttcatcaacaaatgaataaacaaaatgtggtatttctgtgtaatggaatattacacagccatagaaagaaaggaatgaaatagtgattcatcttacaacatggataaacctggaaaatattatgttaagtgaaagaagccacacacaaaacaatggttcgcatttatatgaaatatccagaataggcacatccacagagacagaagcaggtcggtggttgccagaggttggagggagcacagaacagagagtgattgcttaatagatatggagttttctttaaatatggaactagacagtgatgattgtggtacaacactgggaatgtactaaatgtcactgaattatacagcttaaaatagttaaggtggcaaattttatgttttgtgtatttgaccacaattaaaataaacaaagagaaaatataatatttttaaaaggccatgggatgcatttgactaatgtgttgtagtttaacaatgctgttctctatcttcaccatccactagtagccaactcttgctccatgtactgttgatcacttgaaaactgtgaccaagccacgcttggtggctcgtgcctgtaatctcaatactttgggaggcagaggtgggtggatcacttgaagtcaggagttcaagaccaggctggccaacatggcaaaaacctgtctctacaaaaaatacaaaaattagccggtgtggtggcgcatgcttgtaatcccagctacttggtaggctgaggcaggagaatcacttgaacccaggaaccagaggttgcagtgagctgaaattgtgccgttgtactccagcctgggcaacgagagtgaaacaccatcaaaaaaaattaaatttaaatttaaatagccatatgtggctagtgactagtgtattggatagcatgactgcagaaaactgaataactgaaagagagtaagagtttgataaattctcttaaaactcagaggaaagatacattaaaaaaaatagtgatgaagtgaaaaaggacagatccaggaggaatccaaggaggatggaaagagaagacagaagagagacaatgtcaacaaagaaaggaaaaaaccttttacgtatgaagaaataccttggttagttggatggacttaccatgttagcattatcaacacataataaaaagacagctatgctaagacatagcctggtaaaattattctgaattttaaaattaaaatagattttgctatgagcatccaatgcatggaaataaatagattatttagaaagaaacacacaggagaatgatctcatacttttttggggaatccaaatgatttagaaaaatgattatatagttttgttggagaaaatactgagatttaaaagttttttatctagctaagatgggtgtgtctgttcaaaagcagaagaaagacattttctgaaatacagatgctcagaaagtcaacattcactgaaaagaaaaaaaatttatgtaagtgacctgtagagaaagtttaacatcaatttaacataaaacccatgaatgggaaatcatgctgctaaataattggaggaaaatcactaaaactgtaaaacacaaagtttagtataaataattcctgttactatgtttatgatacaatgtacatgtaaagataaataatgtaaaaattattttatattaataatctaaaaatctcagattacttcaaacttggatatggagaagaaaataatgtaaactcagccaggctgtctcaaatgtgtatgttttgatgtagacttatttaggtcacaagaaactgtttttccagtgctatgatatgctcctaatataggcctcttcacaccaacattttatatcagttttatgacggtgttacaggtgaacttatctggagatactagcagaggtggcagctttctccctgaatttggggatgtttattctatcttaccacaagtttctgagagttaccacaacctcatgaaccaaagtgttctgattttatgagacacctcatagaaattatctggctttgattatttctcatgttctctactcatcaggctaattctcaaattatatatgttttcatgtcttcaggggaaagttaaaagcactatgctctattaattgatcttcactttttaataggtggcctcatccaattgatacagaaaacccaagagccacggaaatagaacagagaccaaagcttttttaacccaaaaaatgacaagaagaaattttaaccacagcaggtctgtcattgtgtaagctaacatcttcatccttcaacttccctaacataaaaagaaaaaaatcattaaaaaagagaatagatgtatcaattatcacaataaatgcaaatggtttaaattattttattaaatgaaaaattaaattgagttaaaaataattcaactttgtacggtttctaagagttatatctaaaagttcatggagaaagattaaaactgaaagtattaaaaaacatttcaggcatatgcaaacaaatagaaaacagaggcagggagttaataccacaatttaaagtacaacacagtaaataggacaaagaatggtttaggttgataaaagttatgatttgaaagtatgctataatagtcttgattcataatattttatatgtattattatctagtgatataaagcaaatgctttaaaaataaagaattttaaaaaaattacatgggagacgaaacaaatactttcattctttcatagataatgaagacaaaaatctatatttttatgaaattttgcattacaatttattaggctgaatatatgaatatataacattggattctataacagaagaaatattcctttgcaatgtctacggaatatttactaaaatttaacatagtcttggacataaagaaatcctcaataatttcaaatgggtagaaattaaacaactcatcttcttttgccagagtacaaattctagaagttaaaaagaacaggtttaaataaaaaccacttggaaattgctgcaagatagaaaatatccttcctcaattaattgtatgaataattaaaagctaacatttagaaaataatagactaagtgcatatcaattctcataggatatagtgctaggcaacacaatcatagcattagtattgaataacaaaggatgaaaataaagaatttaacttaagaagttaaagattagtaaaataagcacaagaatagcataagaagagaaatgaaaaaaaaattctgaaaaaccaaatccaagaaacaatataatttttagattgtgcataagcctaattaagaagagtcaaacacgaacttggaaaactacgattgagatttatatcatagggcagccacacattgaattttttttttttttttcttttctgaaaccaagtctcactctgttgcccaggctggagtgctctggcgcgatctcggctcactgcaacctctgcctcctgggttccagcgattctcctgcctcggcctttcgagtagctgggattacaggtgcccactaccacccccagctaatttttgtatttttagtagagatggggtttcgccatgttggccaggctggtcttgaactagtgacctcatgtgatctgcctgcctcggcctcccgaagtgcacattgatgtttaaaagaatgaatacaatttacatttttctgaacagattaaaaaatcttaattaaaaccgtgattaggttctgggcgaggtgctcatgcctgtaatcccagcactttggatggccgaggcaggcagatcacctgaggttgggagttcgagaccagcctggccaacatgttgaaaccccgtttctactaaaaatacaaaaattagccaggcctggtggcacacgtctgtaatccccgctacttggaaggctgacacacgaggatcacttgaacctggaaggcagaggttctagtgagctgagatcatgccactgcactccagcctgcgtgacagagtgagactcggtcttaaaaaaaaaaaacagtgattggggtagggtaggggatatgaataataatattgattgaagaataattaaacagaatggacacatattaggtggcaagataaagaaatgttttcaaagcatttcttctacataagctcttggctcagaatatagtataggtaaggtcacagaaaactcattgcgcagtgtcacattctttttatgtcctgaaatgtgaattttttgagatatgacatttgagctatatattttggatccctactgctaggcttggcatacattaagtcctcagtgaatacttgttgaatgagtgaagtaatcagtggaggcctgctactgataaatattacttcgaaaaatttttggacagctgttgccaatctttgaaccattgtcatttactttcatgtatcttcctcctttctttgttcatgttattcctctgttggtacagccttcctttggaagggtaaattttgcttgtccctcactacttggtttagacatcactttattttagaaaggtcccttttccaaatcttcttccacactaacctcgccaggtatcctttctctatatcccaatagtatcctgcacttgactgtataacacagatactatttgtgcaattagttttcttcctaatgagaccatatggttcttggaggaccatgactatgttatattaatcttccaactcccagcataaacaatgaaatctaggaatttggaaggactcaaaattgtttaacactgcataattgataggtccattttgttataatagccatctcccctctaccatgttttgcaagattctgtgtaacaaaacaagctatgctgattatgaaatagtaattttattcttcattttttatcaactaaaatatacgtaactatcagagtttttgataaggataggaaatcagaaattccaaaggatgtgataaaaatcttgcctgtgcagctttgtagtggggaatgcacaaattttgcaacatttttttctgaaacgttgactcaagggaatatgacttgatagatattaggttggtgcaaacacaattgtggtttttgccattaaaagtaatggcaaaagccacaactacatttgcaccaacctaatagagttgtaggctctagatttagagtttctttttcttttctttgtaatttttgttgcttgtattaggaaacaaaatatgcaaaagtagagaaaatactatacagacaccagcattttgccttttttttttttttcctgcagagttctctttattttcagaaatgaagtcattatggtttgtcttgtctttcacgtcttcccttccctgcctcagtctccagtatggctaggcatgacagtggtactaatcttgtctttggttaaattttgattttttgttcatcctggatctttttgtgccttaatattgatttgtgaaactttagtttctgattgatccatgttttctactcattagctgtttaaccattggattacttatactttaggcagcgttatcacccaaaaaaatctagccaagaaaagcaaactgtgaggtatttccaaggcatggtaatcatgacgttctcttaaagcatcaggcctgaatccatggcctggctgcatatgttaaagtgctgaggtatgttttctgtctgttcccacatctcaagagagaactcccagccacagacagtgcctggatcccttttctaaggaaactttttcctttccttcatcaaagtttcctatacattaagctgcatataccccattgttctggaaaagacaagccaaaaaaaaaaagattatttcttggaagatgctctgaacttctagagaatcagttctttccatttggagctgaccttcaggtctcagcctctgtttcttttcatgtgcctcttttctcctgagttctagagatttcttgggtaacgaccctatataaagaaacacagtaagtgtatttagttgttgctgtgggacagtcactgtggcaggcaattttcatatcttatgttatttactccctgtaaggaggtagtgcttataacttccatttttgggtttggggaaactggatttcacagtggttaagtaatatgttaaatattgcacagggaggaacagaactggaaggccaaagtattttaacattttgctcctttttgcagatacttgagatccattaaagaatctagagagtgaaataacagaactggagctcttgtttagaaagatgattctggtggaatatggaggatggattggtggagacaagggtgttatgattcacacaagagatcatgaccactgaattaagtcagcagcagtaagacagtggataagagatatgtgaaggtggaggatatagattcatgcagcatctttttggagaagctggttgattctttggtcattgccagcaaagtcatttgaataggaaaggccttggaatcacaaagacctgggcacaaatcttcccctcttcaacttccttgctgtaggacctcagacaagttatatattttttttctgaatatcaatttcattctttgtaaaaataaggataataataattttgtttcctcatgacgtggtgaaaattaaacaagatggataatacatgtaaattctttacataattgatctctggtaagctattgctattataattactttattattattagtggaagaattgaaggagggttaggttgatggcaaccacagggagggaaggccagaacttgatgggatacttgatgttttcttctcttaggcaacagttatgggaaatagggaagaagaagttatacagagaatgcagcagagacaggataaactgaaggagaacaagctggtgacctggctggttccactgtctagggcaaggcaatcagcaggtgttctaggcagtctttcctgaccactggtttgaatcctccatactcctgcatttagctttcctcctctccttacttttggagatctgatgcccaagtttcagatttttctttttcctggactcccaatgctgtttttccttctccccacccagtttcttccctcagttctcctgaagtcttcaaggcccatccacctggttttctttgttcaacatttcactggcattcaatccaaagatatttaagaggcatcaactgcgttgcaggcaggaggaaggaattctctgagccccatggagctcactttctctagaaagatatgtcacattctctccactatgctcaacattgcctggtgtctgtttcaaaaactgccagagccactgatttcagaagtaggggatcttcagaggagggaagggaaatgaaaagtagaaacttctattcataggcttaacaagactttgttactgcacactatataccaggcaccctgctaggaagcagaggcctagagatgaaataaagtagctgtaagtttgctgctctcagaaaatcacattctattggaagaaacagacaaatattaataaacagattaataaagtaattacaaactgtggagcatataaaaggctggggcaaagagaataaaaggggtcagggtttgcaatctgctctccttacactgggtggtagctgtgagagtttggccaaatgcaaatatttgctttccaggtcttcataccaaagaataggtgggaaacactagaccaatggactttagtattttttaatacaccttttatttttgaattactttattttatttattattttcttttagacagagtctcactctgttgcccaggctggagtgcaatgacttgatctcggctcactgcaacctctgcctcccaggttcaagcaatgctcctgcctcagcctcccaagtagctgggattacaggcgcatgccaccatgcttggctaatgttttggatttttagtagatacggggtttcaccatgttggccagactgggctcgaacacctgacctcaggtgatctacccacctcagcctcccaaagtgctggaattacaagcatgagccactgtgcccagcctggaataattttagatttacaaaaaagtagcaaagacaaaggacatagagaggtcttgtatatcatttaccccatttctccaaatgttaacgtcttgcataaccatagtactctgctaaaactatgagattcacattggtacgttactagtagttaaactccaggctttgtatttcaccatctttccttgtattgtacattttattgttattgttgttgttccaggacccagttagggatatcacattgcagttagtctggcatctttttgaacctcaagtattcatgcctctctgagcttatttaacacacagatataaaagcagacacaaaagttgaagtattgcttgcataagatagtctgcaaacacgtatgcaaagaggatcaaaaaaatccttgggaaactgggtagccatcactgccccagccattgatgtcagccaagccttttgcatttttcaattcatctctcctgggcatctgggaaagctcctgcatctcaaagatgtctctctcaaaattaagttctttaagcaaaatgggacctggaatgcagcatttataaattacctatgagggcctgtaaacatcagattgttttttttaatttaattgtccttttaaatatttaattcaaagacagggctgggggacggtcatggaggaggtttacaggatgactcaagaaatgtttcctgtctatcaaatggacagcccgcccagaaagattaacccagattcccccaaagaaatctgtgtcaaattgatgctgagttggtctggcatctgaggggaatcttgacatgacaagattaaccctctcagtgcccccgggctctgagagaaagactttcaaaggtttacctgtgcatagctcagcagaaggtcacatagcactgagttctctgcgtgaggagtgtgacacaggaggaagctgggaatgagtgatgaggaggtgttataactcagggggtatttcccacctgattgcactggattgtcactgatgttttatcacactgtatgcttgctgtgaatttgccgtagagaaagctgctactggcttattacagaccttgcagtccacaatggtgggattgtgacacttcacctgctaccagatgaataatctggggtttgggtccttagctcatgaagggacccttatccactgctaagtaacctcttttctccttggacttttgagtcttgattcatgtctttgtaaacattttcactccaaagtgtgacctcctttcctaatttttgcagaaccattaaaccttcttctgttttttaattgttaacctactcccttttctctagactgtatgaattggcttatcttcttagggcttccctagaagcaacatggataccaaccgcttgttactaaacagaggcttagggagaaggacataaggagatgtgagactgagagatacatagagagaggcctatgggtccaggagctcactattttttggttgtcaaacaaaagttctcaaattactccttcttacattgaggccagtattgagggtccaggatctggccatcagaactcacccaagaaaagcagccctgagattgagttctgatggtgcagtgacaaaggtagttcttgttcaggccactcctttgggttttgtttgtttgtttgagtgaaatttacggtttgtgcacaattggaatggtctttaaccacttactcatttgttactctgcataagtgataaaatctctctccaagtttctaccatggaccagatgaagttagttttgacctgaacatcaagcgtgaagaaaagtaagcatctttagctcccatagcaattgtagttggcatctcaagctttcactatgatgtaacgattaaggtgtcacctatgaaaagaaatatccaggattgttcttaagctctacactgggcacccatggaccatatgtgagctctaggtttgttttgtttgaccacacaggtgaacgtgaatcactctgcatgggacaccacagcccccacctctcctattgttttatgcccaatctgcttcatgtatttgcctcacatgtagtgggttggatagtggatcccaaaaagttatgtccaagtcctaatccctggaacctgtgaatgtgactttatttagaaaaaaggtctttgcagatgtaattaagttaaatatctcaaggtaacatcatcctcgttttagggttggtcctaaatccaacgacaggtgtacttataagagaaaggtagagaagtttaagtggagatggagacagagatcagagtgatgctgccacaagttaaggaaggcctgggaccaccagaagcttaaaaaggcaaggaaggattcttctcccctagagaccttagatggagtatagctctaccaagacttcgattttggactcttgacctccagaactgttagagaataaattgttattttaagcaccatgtttatgttaatttgatatggcagccataggaaatgaatacactcctgcagtcataacacatctgtatttgtttaccttttaatctctgtgtgcttgtgtatgtatatttgtgtctctgtgtatatgatatatgtgagtatgtgtttatcaagtgttgaaggccgtttagactcacacaactgctggtcactattctcctatgctcgtgtcttccttctctggccatctttttcttgtggctttctctgaatctttgtggtacctgtagtttttgtgcatctggtaccccttcttctttattctggtgacagaagccaccactctgatgataataattaatttatgctttgagtaattaattagctaaactacaatgattttgaacacctgataaatatgccatgctctgctagggactgtagttatagtggtgaccaaaaccaggcagtcttttatgattttttgacttatcctctgtagtgggcatggtagacacgttgatgcaccattgagattctcccaaggaaacagagaagcatggtgagcagacaacacctggcttaaggtctaactcagctgcacagaacagcctcacctaaggccacatatttcctggggcagcttacctccagcatgagtgaggcagaaggcaaataatattgttctggagctctctgcccaagagaggcttctgggggcctgaatcacaatttgacttctttctcagcccaatcttcctttctgcccgtgccttccacaggtgttaattcctatgccctgataaatatcttgcactccaaccttcatcttagcatctgctttcagagaatccaacctggacactgggtcagagggcaactgaagcaatgcttattcaaagaaatgggacattgtagtgtgataaatgctccaaaggaaagttccctggtttcttgttctcatgtctacacttggagattgtccctctatctcctacctggatggtggcctaaatgtgggactcaattcctttcttttatttacatacacgcctatacatagccacacagacaaagctgctcatatgcaccaaaattcaccgcaacaatgccttgcacagatagaaggtatttctgaagatttggtaaaatggaagagttgtacaatgagaaaaggcaaatggcttaaaatttaaaaatagatattccagttctttaaaaagtcctcttattatttcttccaacaggggcttagtctattatattcacaagttcctttgattttgtggcttcaacactgtacattattatgccaagcaaaatctcttcttgcctccatttttacttctcaaccctttaaaattacagccccttttcttacacaggtgtattcatttgaaaaacctcacagaactatacgcttaacatctgtatattgtattgtatgcagttataatactccattaaaaaaacctgtgcctcctcaggcccatagaaataagtggctatgcaacctactattaattatacctttactatccaatggtctagcaaggctttcgagattgatttctctttattgatatctgattacattcttggggaagatggcattcttttccctcatttgactcatggctcatggggtgaggtgggttatttcttctggcaatatttgcttatttcagagcaatttttgctacactgtgagctctttgaggggaggagctatgtgtccttgtttctgtgtcacctacaccttgcatcaagcctgaaccaaagaacagtctcagtggacactgaacgcaaaaactaatcaattgataaatagaggaaggaatgagtcctaaaaaaatgtgtaggccatgggaccatgaatggagacatagccaggaatttgtatagctgtggcttgggtcttgagtaccattagggtccagatgatttgggttggaacatgagccacactagaaacactcagagtttgacccatatcacgcggccttctaatggtgatccctgttgctccctatagtcaaaagattcaccttcatattcagaactcttcttcatcaacttcatagtctctatgcaggttattaacattcataaaccattcagacaattgctcattcattccttaataaacttttttaaagctaaacatactaagaacttttatgaccttgtgtctttattcacattgtgctctttatgcaaaattcccctttcctatgtatttcctacaaatggttgttgcaaagcacatgggtgttgaagtcctgaagatctaggttcaaattctaagttggccactcatgagctgggtgaccttgagcaaatcaccttaacctttctgaaactcaaattcctcatctatagaaggcatagtagtggtatgaatgataattatttcacatggttgttatgaggatgagatcaggcaacagatttaaacatatttgagaccctggcaccagaattctacaagttcagggttctgagagtgaatatcttcataaatcttgcatcctagtcacctgtcttacctcagtctagactgggacctgcctggaacataatagttgctgatttcttcccccctctctctcttttttctgtttcctccagcataaataattattacaaattatattgttattagtctagaccagggattaaaaactgtggcccaagggtcaaatccagcctggttatgtaaataaagttttactggaacacagttatgcccatttatatgtgttaaaacttattgctttgtgtcatatacttattatggtttcctggcttatgcgcctaatggtgactacagatgttcttttcattttgttatggaatgtttcaagcaactatacttttgcttaagttgaacccacggtgggaaacatttatgctcctttcatatcagcaagagcagcctcctttcccttttctcttttaaattcaaatttatcaaccacctaaatctagtcaccagatttgtcatagagaggcttcctataggtttgggacctttgctcaaatcagtacttttaagccattattagattgtgataaaaagggagataacacagggcctgatgcactgacaatgagcagagcagcagaaatgtgagatgccttctggttggcttcctgctgcttacttggcccgcttgcctcaagggaatcattctcaaactttctgtttcaccatgtgatagaaatctcattacatctcaagagcctattttgaaacttaaatcataagggagaattttaatgagctgagctttgcttaagctgcagagttgagtttggcaatatgttggttgagattgtcatggggagttatctttctggtttcaacaatcagaaaattattgggtcatggttctgggagcttctggcttctttcttacataatattgacaagctacactttgattagcattcacaaaagcatcacaaaaccaaatctgtataagtaggctgtccttttacatcctcaggtgaggaaaagcctaaacatttccttctgttttttagtcttccttcataggtcctttatgatttttgtttatttttgataagaattaaattatttactaaagtttcaaagagctggattcatagaatagggcctgagtgcttcttttcttgtgtctgaaggcagagatgaatttctcatgttgtagctagcaacaacaatttgctagctgactatatttcaggaaggctttgaaccaacaagcaaagactagctagctttgagtccaggggattagagcagttgaaaataatttttccactggaggggaaagtcagtgacttactcttacaactgttttaactcaggtttattgagtttgttaataaatctagttgaaaagcccacattctctatcttagtgtttctcagtgtgctctgcagattagctatactggaatattctagagggaacttgttaaataagcagatcctatggacctactccttactcagtgaaccaaaatcctgtgatgaagttaggggaggggatgttgaaaagcggtataattctataagttaaacaagatctctgggtcattcttctatttattaatgtttgagaaccaatgatgagtaaaatattctctttttattgctcacagtggagtttctaaaggcaatatgtacaaagtgctgcagcataggactatgcgagatggcataaaaagacagaagatggaccactgagatgacctgtcaattcattgattgtcttactacagttggctgaattgactgaaactccatctgctttgttggcacatagacaagactttattggtagaacgttgagagtaattggtttcatatgatttttagataccatcactaaggacttttgagtacgttttgtaagagactttcaggagttgatacaagaagggaaaatgagctcctgggcacctctttcacatgtagtgaagtaactcactccagccttctcctgactttcactgaacccctgaaggagtcgactgctttgctatggggctgaaagctggtattcatgtatattaggcaattcttgccccagagaactttcaattcagctgcataaataaagtaactacaatttgtaaaacctaaaacctattatatgttagtcaatgcaaaatgccagatgagtagaatagattatgaatttaggggcccagtgaaaggtgacattcctgttttcctgaggacaagaggttgtaggaaaaaggtcaaaggatttaagaaatattttttggatagtaccttagttatagttctccaaagaaacagaactaataggaaattggaaaccaatagaaaatatatatatataggtgtgtgtatatatgtgtgtgtgtatatatagaaaacatatatactatatatgttaatatatatgatatatatggtatataaatatatagtatatatagtatatataaatatatagtatatatagtatatataaatatatagtatatatagtatatattaatatatactatatatagtatatatagtatatattaatatatatgtagtatatatattttctatatgcttgtgtgtgtgtgtgtatatatatatatatatatatatatatacacacacacgtatacatattttctattggtttcccatttcctattagttctgtttctctagagaattgtaactaatgtactaatactatccaaaaaacaattcttaatcctttgacatatatatatatatgtcatgtgtgtgtgtgtatatatatatatacacacacatacatatatgtaatatatataatacatatatattatatataatataatatagaaaccttggagcttcctggatctgaatgtagatatctctccctagactttggaggttttcagctatattttgagaaataatttttctttaactttctctatctcttctttctctagtaatcctataatacaaatatttgttcacttaatggtatcccataagttctgcaggctttcttatttttttaaattgttttaccaccatttgactgggatattttgaaacacctcttgactggggtattttgaaacacctgtctccaagttcagaaattctttcttttgcttgacctagtccgtttttgaagtgctcagttgtatttttttatttctttcattgaattcttacctccaagatttttgtttggttcttttaatgctgtctatctttttgttgaatttttcattcagatcatgaattgttttactgatttcattgaagtgtttctctgtattctcttatatctcgttgagtttccttaatattattttgaattccttttcaggcattttgtacatttatttttctttgcagtctgttactgcagaattattgtgattctttggaggtgtcatgttttcatctctctcatgtttctctctctctctctctctgtctctcttcagagcacatatgtgtagccaaccacgatccctggtggactgaacaaagggggccaacgtgggaataaaagacaagagagtatatttggaagaaggggtcgggggcttcttgcctatagtggacaaaggccctgagctttttcagccctctgaatttattaggtaaaagagataatgagaaaggtggggggtgatttttgggtaattgtcagtcagccatttggttcacagcaggcttgcgagactgcatcctctgaacaacaggcactagatttcccagtagataacttcaagaagcctggcgccagggagtaatggccctcagcaaacctcctggcagcaggtgcagtcgtgagtttgctcacatcctgcatttatgataaacagtttgctgtttgatcatatagcctccagtggaatgtggagttggtcacaatccctttggcctttttggctcccaacacatatggcccatcaaacttttcccatggggggctgaaactatacctcctataattatttactggctgtgggctggcataggaagaatgtgccccagatatgcagctttgtgcagttgaggcaaatgctaaaggagccacttccaagggcgggggcaatgagtccttctttgcagagggatctgggaagctcatctttctgtcccctcactataattttagttcactgctactgtatagagcagtggtccccaagctttttggcaccagggaccagtttcatggaagacagtttttccacaggtcggggtcgggtggtaggatggtttcaggataaaatggttctacctgagatcatcaagcattagttagattctcataaggagcactcaacctagatccctggcatgtgcagttcacagtagggtttgcaatcctgtaagaatctaatgccaccactgatctgacaggaggcagagtgcaggtgataatgcttgctcatctgctgctcacttcttgcttggaggttcagttcctaatgggccacagacagcaccagcttgcagcctggggattggggaaccctggtctatagtaatgcaaaacatattgcttccatgtttctgaggactgaccatcaggtatttacaggcagtcaacttgcctactacattttatttgtaatcacacctggatgccatttacacatacttagtttagtttaagcatgtgcagatatgttacctcttcctccttgaaaggcttcctggttaccctatgtggctgtttgttcaccatctttgtatgggactttgaagctgaggacttggacagttcctagtgtgcaagtggtcagaagccctctccctccaaacccagtgacaatgtccctttagtaggattaaggtgccctgaggacctttgctttttaaattaggctgacacggagcttagcaactataagttcccccttatcctccctctatttatcattaatatgttgaacttctcagctggcgaaggataaaatagttgatagcaaatgaattagatatcaattaatttctaaagcaaacctaatgggcatttaagaagagaatttaatgtctcatttactctctatagctatcttgttaaatgccaattaagtatctaaatatttcctacaagcttaatgaattataataagtaaaaagtgattaccacttttttctaggatcttggcactctcgacttccagtgcaatgatactagactttttttctcatcctatttaggatacagataaaatagactaaaaccttcctaattaacattagctaccttatttagcaataaagtactaaatttatagtcaattctgaatataaaaaatatcagaatgcatgcagctagagaatatatgagtaataggatttttacttgaaaataaagtgagcactactaaagcattacctataatgaacgcctaatgtttcaccttctcaatgcctgcctcacctcaccccctcactgaaaccatttctagacaccaaggcagagagcatattagcagactcacacatgaattaatggggtgtgtgtttgtgattggcatggtacacaaaaacctaaaggcagcaggggccaggacagtggactccatcatacaaaatggggaaggttaaggaggcttggcctgggatctagcccttcaaggttttctctgccactctgggagaatagagtgatccttaggtttgcttatccaggctttgatatctaacagtgcactgtgggattggagagattagcagtcaatattcaggtggcaggcttaatgaactactgtttcactctaaggagggctctggtcctcagtgggagatgcagacggcaaagaagcagcccctgaaagtgagggtttgggtgggactgcagtggaaagaggtggagaatacctgccagacaggagtaacacagtgctcctgagcagtcagctctggtaacgtaactcagttacatcatgagttatgtatggatgtcattcagttcagaccatggagtggaggtcaagggtatgaaatttgggatcaaatagacctgagcttgaggcccaacatggctcatacttgtcctatgagcttgtttattttgaagattaaaagagagaatttgcttaaagcatgcaatacaatgcttaccaaatagcacacattcagtaagtgcacttattattagagtgaataataatggtaataaaaatattaaggatgatgaagtcactttgtttctgagagtgtatctgatttgtagactatccgtttgatagctcttccttccttaggaaagttagttaagtcatgattcagttccttcctaatgaaagttagttcagtacaacctgaagcatgtaaaatttccacgcagagtgttggtgtgcctgttccaatgatgtcgccactgcatgcaacattcatataatgacctcaagtgacaaaaaaaatccattatttttttcttccagagaatgaagggaacactaggtcattgttacatggcaacagctacttctcaaacaccttgttcaggaaataccttgttccaaatacatgctgcaaggctgagaaggactcttgcaactgggcacaggggtacaaacaccacctcatttcccaaggacagctccgctcttcaatgaggccattcatcctggccctacacaattactgtcgcttacacaaacagttatggagcattcaaatgacaaatgctaggcagccatccaagtcacatttctgaaaaatatttttattacaggaaaatgctcatgatgtagcattaaaaagggggaggaaagcaggaaaccaatcaaaagcagcagagaaaataactagtatagatccctgagttaaactcagcctcctttctctcacctccaggctggcctcaggaaaataccagacagaaatcaaaaggagacaaagatctaactaacttcatatgcatcaacaggcaatactggtctttactgtgatggttccttttggataccaaggcgggagttttgctaatcatgggaaaagttcctaaaattcccttctcaatagccttctcctaaagtccaaaccctccagtagctggccaaatttttgctctcctctctctctttttgcctccaaaatattctcattcctgagtttttttgttcatgctactatccattctctgtctaacctcctccatcttcctcacctctatttttttcttcttttggttatctctatgtgtaagtcaggacatgagaaaatgaacatttgagccacaaagcctgggtttgaagcctgcctctgaaattgcctagctggataatcttgggtgaatttcttaatctctctgtgcctcagttccaacctgtataatggggatgataacactaacacacagtctcttggggtgcttttcatgattaagtaagtgagtttatatgaattacctagaacattgtttggcttaagaactgaataaatgttcagcactatcatcatcatcatcatcatgtggattaattgaccttccctccagcttcttcaagctttttctccacccattataatggcttttctcccaaaaaaaaggggaggaaggatttgcaaataattcttacttaacatatatttaaaccctgtcatattattcaaaaaaatgcctgcatggaaatgaatctgtgttaagcagaataatggtcccccaaagatgtccatgtcttatatcaggaagctttgaatatgttaccttacatggcaaaagagtcttggcatagatggtgaatttaaggatctacagttggggaggttatcctgtggcccagtgtaatcacaggggtccttataagtgaaagagggaagtaggagattcagacaaggaaacagagatctagtgctgtcattgctgaaaggggccacaagccaagggatgtgggcagcctctagaagttggaaaaggccaagaacaggtcttcccctggagcctccagaaggaatgcaaccctgctaacaccttgactttagccacataagacccatttttagacttcttacctctagaaatataagataaattgctgtatggtaatttgttacagcagtaataagaaatcagtaaagtgtcaaaactatagctaaaaatattatgtatacaaagatagatttctgagaagttttccttttctttttatttgaactgtctctgtcttctaaaataagaaggcaaatgctaggctaagaaatgataaattacagatgcctgacacatgccaggactgttgttatgctgctatagaaagaacccaagcatgtggatttggagttactacaaatgcatggtcattacccatcactgagcttaaccatggttcctggctgttacaccaactccaccatccacttaagcagatggatggtggagacttctccatctgcttaagttctttttaccgatgcattgcaaactttactgtgtatataaagaatgtggggatcttgttaaaatgcagattctctcaatatcattagacatcgggaaaatgcaaactgaaatctcaaacaggtaccaccatataccactggaataactaagatgaaaatgactagcaagtcaccaataacaccaagtattattgagaatgtggttcaacttgacctcatgtatattactagtgggaatatagaatgtatttggaaaactgtttggcagtttcttaaatagttaaacatatatatagcatgagatccagccatcccactcccagatgtgtacccaaaagaaatgaaatatgtcctcacaaaaacccaattatgaatattcaggctgggcgcggtggctcatgcctgtaatcctagcactttgggtggccaaagagggcgcattatttgaggtcaggggttcgagaccagcctgaccaacatagtgaaaccccgtctctactaaaaatacaaaaattagccaggcatggtggtgggcacctgtagtcccagctactctggaggctgaggcaggagaatcactggaatccaggaggcggaagttacagtgagctgagattgcacaactgctctccagcctgggcaacagagcaagacttcatctcaaaaaataaaaaagaaaaaagaatatctgcagcagctttattcatagtagttaaaatctagaaacaatgcaaacagctataaactggtgaatgcagaaacagaaggtagcactcacacacagtgaaccattactcagcaacggaaaggagctactgacatacccaacaacacgggtgaatctcagaagcattattctgagtcaaagaagccagacccaaagacagcatactatatgattccatttatagaaaatgtaagctaatctctagtgacacaaaacaaattagtcatttcctggggctggggcagagggaaggagtgaatgtgaagaggagcgagggatctttgggagcgattgagcttttccgtgttttgatggccatggtggtttaatgggtatagatgactatcaaacttcatcagattttacactttaaatggatgtggtttattatatatagattattcctcagttaagtagataaagaaaaaataaagcagattctgatttatagctctgggctgggcaggcaagttaacatttctagcaattcctcagttgctgccgatgtactgggtcccaaaggctccagaatatcttctcttcaccttttgcacttgcaggagacacatttgtgtccaattttgctaagaaaatcaaggacttgggtaaggaaatcccttgaatgtcttttccctaccccctatgaatataaatccacttgtgcaacaatttgaatatatgcaagaaaaaatacttcaaaaggtacttctgctttaattgtagccttaccaatgccaccattcaccttttaatgatgaccttggcctgagctttaaattgaagcacgtgtgattagcaaccaaaaattgcattgggattatagtactttcactctaagtctttgagcaaatttctaggctttgcttaaaacatccattttcaggcatgattagaagacaattaaaatagaggggtaacagaaacaataaaattaatactttttgacccatgagggattagaaatagttcaagacaaaagcagaaaggatattggccacctcgtgcccttgcttagtgatattcatctgccattggacaaacctgggtttctctgtaagatgtaaggtatccatatgtaaaagaatcccttgacattggtacaaatccttcgcaaatcttcacatacttaaaaagcactctgtgaagaacaaagctttgttgagaagctgtttctaggcagtcttcaatgctgtctctctagtgacagaatttgtttcaattggagtccatgtgcaatccacgcccatgtctcaataaaataatcaattaaaataatttggggtctttagaataatggtaattgaaatgatgggtgctgtataaattccaaattccttgtgtactggccaaaacaaaataaaacgaacaaacagaaacactagagaaagcgatgggtatggctatggtagctataatgttttgtagattttattaactgtctatgctttcaatatctctaagataccattcaagcattgagaagggagctttaattgctgtctttccatctgcatttactcaaaacttacaccataaagaaatgttctgtctcaagtatcaatattgcatcaattgtgtttctgttcctctagctatttgcccctatggtgtcatttcatacattcatagaaacatggagaatttagaaattatggcccttctccagtacagttgagttttatctgtctatattacttggtgtttagcacattgtagctgttcaataaatgtttgatttcttacagaataatagtttgactttcaaagattttaaaaacaatctttttaatctggtgcaagcttggacaggaagactgctaaggcctagttagctcagaggcagaacaactgaaccaacctttctatgtgtgtcagacacaattttgttttcctgtttgaaaaggtaaaaacagagtcacctggctaaatggtttcctaaatgttccccctcctctgatcctcatgactttataaaacaagccaccacaaaacttctctaaagctaaactaacgtgaaataacccagggcttgaacttgtcgcatgacgttgctttaaattttaatacgagcttgggaatagatttgtgaacagcaaggtaaagcaaagcccatgaaatattgattctgtacattttcttatgcatttttattctccaatttagtaaatttttcatcttgcctgcacttaaaggttggctatgaagtcgttactaccaattgtattagctgttgtaaataaataattgtcgctaaagctgtttgcatgacgagaggtggacagggcctgctccttgtgagcactgactttccacagcccagcctagaaggatgaaagagatgaccacattttgcctaacagcacagtagcagacactttctaagggaaggagggttttaaataaagcaacaatgaagagctctaatgtttcagtagggactaaaccaccattctgacaatcatccattttggtcaaaaagaaggcagaattttttttttaattacaggacatcaggatagaatttcataacatgcatgcttcttggagataccctaatttcatggctctatgttagagaaattaaaagtgctagtctttcattactagccctcatccttgtatatgcataaaaagtcatattttatcagtcacgtgaaagacaactccattacatagttctcactgtcctcattctgtaatgtactcttcttccctagaataaacatgtatgcttctgtattcaacatatctaacaggaggtgagagccaaaagaaagatggaaaccaatacagacaacaaatggcacatcccttggtaaacaatgcatagaggatccagtgtggttctgccactgtggcaatcattctgattctttgtacagatttcatacattaactcattacttctctgttaagactgacttcagtttctctagaatcctggtcaaattgaccaaagaaaagacttcccctgagttccaaatttcttattccatgtgtccagaacataacaggaaaggagagaggataaaatcaggctaatatttagctttgaaatagctaaatatatctcctttttattttatcaggaattttgtcaccctgttaggcaaataataggatgcctcatttccagatttccccattttatatttattaaagttatatatgcttgcttattgtagaaagattttaaactgtaaaaacaatgtagatgagtttaactctgtttctgatgtctctacttgccaagaaagaagcaatatgggaggagaataaagacttccaataggttgttacctgcatttttggcaggtaaaattggcatacattttaagtgtttaaataattttaaatccatcactagtatgtttctctgcttacttttaattcctgaaacacttgatttatatgttatctaagaaagaaaaaaaacctacatagagtccaagtgggattttcccccctaagtttggtaagttttgtgtttgttcagtaagtctgtatacgggggttatgggacaatcttaaatttgttcattgaaaaccactgaatattgttgacttgagccatatattttgcacaaataagtcttcacctgcaaatacttgtacctcaagacagatatggcacaagaaaaagtatagcaagatgtatcaagtaaatacaactcccagatgcttggattaaacatcagtatgagcacagacatctttctcctcttaaactctccactccatccctagccaaatgtctattaaagaattaacaaaggtacagcataggcagagatgaccttagaacaagggaatggaccaatcaaattatggatggcttagagaaagttttggtagatatagtgcacaaggcaacaaacaggaatatagaaagagttcaacttaaaactctttcctcagaaaaggcattattaccctgaagaagatacaggggctcaggcacttatctggaggggtaagaattgggtacatgggtaggccatgtggtagatggtgacctcataatttgggcttcatttgaccttcaagaatcagcatcatttgtaacagcaagactttgagtgtccaggattagaaaggcagccacttgaagaagaaaggggcaaaaatggtgaggacctgtacaaaaagaaagaacttagagcttagcctgagggaaatcattaagtcttcccaatttggggtagaatgtgaggagagctcctgtggttgatgccctgattctgtgaccagcactaacaagatcagaagcgtctgaaaccagaggctttagggagacatagtattcaagttgctgttacatcaaagaaaaccctttcagggttacagaggcatttcctccatgtatcaagcaagagaaccaggaaggagcctgggcatagccaaagtttatattggagtacaggttgtgccaaataccaagtgaatacaaaacattgagctgagagcaatagcttcaccatgcatggaaagaattgctgcagagataaatattcctgtgaatgctactcagagcccagacttcctcccaactcccctctggctgctcaataacaatgagagtgttgtaaatttacaccaaagaagccctccagtttgagatctgagaagccaagaacaaccaaggggaaccagaaggggaaggaaagacaatttactcaaaatgtttatggaaaaacaccagctctgcttacatatctcatcacttaaagatgaacaactaaaacaacaccaacaccagctctatgaaaaatctcaaaatatgaaatattgagaaaatgcatgcaatatgcaaaagacataatacaaaaaagagacaatgtcaagaatgtcttcttgtgcctttaatactatttgagaaattaggggctctgtgaaaccagtgatgagaaatgggataaaaatatttaaacagaagagagataggcaaaccataggcagttttcaatagaaagctaaacaatataagggagaggaatgcaaggactgagttcagtacctattttaggaaccttaaaatgaagagaggatactgcaagagtcaaataagtgatgtggagtacaaatcaatcaggcttgcctggagtagagaggaaaaagtcaggtgatgagaaagaagacgctaggaatgggaaactagaacttagatagaagagacctaatttgtctctggaaaagatcccaaaagaaaaggaaggaagcagaaatcagagatataacagaagaaactttcctgagtaaaaaaactgattccatggaaacaccaccatgtgccatagagcattcatgaatacaaaggaacacctagatacatattgtcaatttctttttaatcttaaggaaaaagaaagaatatgtcaaacataaaaggaagagggggttgctaaacaggaagaatgggacatccatctaactcaagactccttttataccacaagagatgttaggaaaaaatgaagcaatgtctatggaactgagagtaagaagctggaatctaggaattctaaactcaggccagattctgttcatatataaaaacaagaataaaaacaaagagaagtaagagagagagagagaggtctttttcagatatgtaagggctccaaaacccaagcaagtcttatattttcttaaaagttgtagcaagtttgctttatacaggaattggttttggtggatgatgagagacaggaattcagaattcttttttctcatttggataaccacactattgctgacttggtcccatttatgacattttccatccttttcacaatgatttaataatttttaatgccccttatgctatatacaaagttcccttatatgtatgagactacagttatgctatccattttgtttcattaatcaattcattcatcactgtactaagactacattaaatattaataaagcattagaataaattctgatatttgataaacctaggcatccttcatttttttcttttcaatttcagtattttatttttgttggtcaataagaaaggatgttttagcctgctatttgtaaaacttctgcaaatttttttttaatttttaatttttatgggtacatgctaggtgtatgtatttatggggtatatgggatagatattttgatacaggcatacactttataataatcacataagagtaaataggatatccattctttttcttccaaattgtcgtggcaatttaagaattgatttatcaagactcataaaaactaagtttttggcttttgattggaattaacaattaaggtggagatgttttcatgatattgagtactcctgggacatattccatttgttcagttttttttttatgttctaataactgtttataattttctccatgaatattttccacatctttgttaggttcctactagatatctaattgttggttgtaattgtaaatgctgtagtttttctaacttattttctatttgattttgctgatatacaagaggagtattgaatttttggtttgtattaaacagatttggtgaattattttagtgataaatgtggtttatggatttttatgaattttctatatgtgcaactatattacctacaaataatgacacttttgactcttggtttccatttttccacctctcttgttttcatgctttgttgcattggttatggcctccagtggaattttgaagggtggggtgatttctgcactgactttgtgatttctgtttaacatgtttctttcttggatcctcgaatttagatttaaggcctggacaagttgtcttttttcccctaagtctctaacttcctgagctccagagttttcttatgaaaagagagagaaaagaaaaaagaagaaaggaagcaggagaaggagaagaagaagaaagggaagaggaaaggggaagggggaaggagaataggtgacaaagaaggggaggaggggccaggggatgggagggagagggggaagattctaaccaatgttctttttttttatttttttattttttattttttatttttttttattattatactttaagttttagggtacatgtgcacaatgtgccggttagttacatatgtatacatgtgccatgctggtgcgttgcacccactaactcgtcatctagcattaggtatatctcccaatgctatccctcacccctccccacaccccacaacagtccccagagtgtgatgttccccttcctgtgtccatatgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacattagggttggttccaagtctttgctattgtgaatagtgctgcaataaacatacgtgtgcatgtgtctttatagcagcatgatttgtagtcctttgggtatatacccagtaatgggatggctgggtcaaatggtatttctagttctagatccctgaggaatcgccacactgacttccacaatggttgaactagtctacagtcccacaaacagtgtaaaagtgttcctatttctccaaatcctctccagtatctgttgtttcctgactttttaatgattgccattctaactggtgtgagatgatatctcattgtggttttgatttgcatttctctgatggccagtgatggtgagcattttttcatgtatttttggctgcataaatgtcttcttttgagaagtgtctgttcatgtccttcgcccactttttgatggggttgtttgttttttcttgtaaatttgttggagttcattgtagattctggatattagccctttgtcagatgagtaggttgtgaaaattttctctcattttgtgggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctagaatccagcagaacatcaaaaagcttatccaccatgatcaagtgggcttcatccctgggatgcaaggctggttcaatatacgcaaatccataaatgtaatccagcacataaacagaaccaaagacaaaaacctcatgattatctcaatagatgcagaaaaggcctttgacaaaattcaacaactcttcatgctaaaaactctcaataaattaggtattgatgggatgtatctcaaaataataagagctatctatgacaaacccacagccaatatcatactgaatgggcaaaaactagaagcattccctttgaaagcgggcacaagactgggatgccctctctcaccactcctattcaacatagtgttgtaagttctggccagggcaatcaggcaggagaaggaaataaagggtattcaattaggaaaagaggaagtcaaattgtccctgtttgcagatgacatgattgtatatctagaaaaccccatcgtctcagcccaaaatctccttaagctgataagcaacttcagctaagtctcaggatacaagatcaatatacagaaatcacaagcattcttatacaccaataacagacaagcagagagccgaatcatgagtgaactcccattcacaattgcttcaaagagaataaaatacctaggaatccaccttacaagggatgtgaaggacctcttcaaggagaactacaaaccactgctcaatgaaataaaagtggatacaaacaaatggaagaacattccatgctcatgggtaggaagactcaatatcgtgaaaatggccatactgcccaaggtaatttatagattcaatgccatccccatcaagctaccaatcactttcttcacagaattggaaaaaactactttaaagttcatacggaactgaaaaagagcccgcatcaccaagtccatcctaagccaaaagaacaaagctggaggcatcacactacctgacttcaaactatactacaaggctacagtaaccaaaacagcatggtactggtaccaaagcagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaacataaaaaccctaaccaatgttctgataccactgcttctgttttcttccaacccattcttctcaaagcagccagcaaagaaaaataaaaaaaaatgtaaattagattatgtcacttctttttgcaatgtccaacaatgctaaaagacacacgcgcgcgcacacatacacacacacacaccacacacacaccccagaatgcctataaagatctgctcctgcctacctgcccagtctcatcccaagccacagtttcctttggtctctgtattccaggcaccctgcttccttcccattctcaaatgtgccaagctctttctcaccttattgctttcatgggcattattcacgctgtctggagcctactgccctccactgttccccttactagcttcacttccttcaagttttatatacaatgtcatttacctagtttaaattaggtcaccctgtaacattccagtgttttagaacaaacatctgtttttcaactgaagcaaattcccatagccaaaaccttttaaagtgagcaattcagcagcatttggtacattcacaatattatgcaacaatcacctctgtctactcccaaaacattttcatcaccccagaaggaaacattgcacccactaagcagttactccccactgctcactcccctcagcccagagcgatcaccactctgtgtctagtctctgtggatttacttattctagatattcatataaatggaattctataatgtgaccttttatgtcaggcttcttttgcctagcattatgtctttgaggttcatccatgatgtagtaacgtataagtacttcagtcctttacgaggctgaatagtatttccttgtgtgtgtgtgtgtgtgtgtgtgtgtgtgtgtgtatatatatgtatatatatatatacatatatatgtgtatatatgtgtgtatatatatatacataactcattttgtttatccattcatcaactgatggacacttggattgtttctgccttttggccattgtgaatagtgcagctataaacattcatgtacaaatacctttttgagtccctgttttcaaggcttttgggacaccatgctcttttaggttgttgcatgtatctatgcttctagtgtggtacctatgtgtatgattctttgtttagtgtctgcttgtccacactatttgctgaactccatagctgcaagggacacttgtttttttcaccattgtagcatctgacatgaagctgaaccataggagatatttgacaaatatgtgtgaatgaatgaatgagaaagcaagttgcccagattgacgaccaagctaaaggatgagacttggggataaacttttgaggtatctggaatgagataaggtgaggttttcatgtggttcaatagcagcctcttcctgtcactagaaagacttggtcactatcttcagtgaccaagcatcattatatctgacacattccaaactttgaaaaccccacatagtacaagtttagggaaaagagttttagtcatactttgcctgttccaccgaggccttagttggtgatgtccacagcaaaaactcagatttttgctcagaattccagctagggctctccagagaccacaactcccagggcagagctcattctgcatttccaagcttttctttctggatatcttcagcaaggcagaactggacaaaggtgaatgacattcaaggttaatcatgctggcgttcgtgattccagtgactgtatttgagtttgtttttcaattgttcttttgatggctattctacttctgcgtgccaacattctcagtttgtaatgccaactgtgctctgtagtgaacaagaacaagcctgctgcgtagtgtgagggtggcagcagcttgagcatttttatcgtctactcattgtctctgctgctgtgtctttcagtcctcctctgattctatcaatgagtctctctccctctacctttgctctgtctctgttttctgtctgtgtttcactctgctctgcttcatgtttctctgctcttcttcccgttctctctctgtcttcacctttccttgtccttctatgcctctcctaggggaggggatcatgtgctgcacaaaccatgtgtgtatattgttctgtctcttcaggctgttgttatccctgtcaataaacttcttcctgtctccaagtgactggtcctatctcctttacaatcaggggagaccggaactggctgcaatgaatgtgaggaagtctttataattaacaggatctctctgccatttacacaaacactttaaactacatagggagccaagcataccgtttgcacgtctgatgagaaggtaataaatgtgggggagtgagtggaaaaggggagggcagactgaggttaagtaacagggagagggtgctgggaggcatcagattaacacagggtggggtgggtatgggacgtttgtatttagctaggctccataattatgctctgacactttctaggtgccaggcactgagctaggctttaggaatagaaagctctaggggtagagactccaccttaggtgaatttagtttaagaagaggatgtattaacaagaagacacaatgtctgagtgcagtagagaagcagatggtgacttgtggatgctctcagaaggagagaaggagatgttagaggtgcagtgatgtttcagtggagccttgaaggaagaaaatgatttgggtagagagaagctgcagaaggcaagacattcttggctataggaaacatctgagccaatgctcagggttgggaagtcaaaggtatttgaggaagaatgagaatgtcctggttttaacagattggggttgggagaatggggagagaaatggataggcaggggctgtgatgtcagaagcaccaagtgtcccataggattctgggccattactccgtggggagctagacaatgtcatgaaactctatgacagcagtgtccaatagaacctcctgcatggcagaaatgcttctaacatggtaagctgcacagggatatcaagaattgagtccttgaaacgtggctgatatgacaggggagctgaatttttattttttttaaattctaatttattgaaatataaatgtaaatggcccagatggctgatagctgctatgtaagacaacacacccctgagatgtcatgaccagcatctctgagatgtcatgaccgtattgtcaggtaggcagtctggccacagtgtgacaaagggactggagggcctgatacttcagagagagcaatcgggacattcatggaaggaggggcaggtaaggacataaaccaggtgaggaccagggacactcaggattgagcaccttggctgggggatgtcatactggggagtaaagcccagggatgggcctctgggaggtgctggcccatgcaactggaggccagcagcaagctgccacagtgttcatacacccaagggtatacatcaggcctgggatccaggttgggaatatgataatgagattgtgaaggtctttgatggtaatttagctgtgaatcttggaatatctaaagcttgtctttgataagccatcccttccctgggatctctaagaatatattatgtggccgggaaacacagcaagccaaaaacacctcctggctcaaaggtcctaaaactcaaaggtgccatagggcctcctctgcttccttttcctaatgctgcatttcatcttctgatgaaaaatgaatttaatttaaagcaaagcaaatttaataaaaatccagacaggtattttttttttatttgttttggtggaacttgataaaattggtcctaaaatattcatgcaaaaattaaggctcagggatagctaagatacttgtgaagaaggagcaaaggagtcttgttctttcatacagcaagatttatttcaaagatatgataattgaagcagtgtaaatttggtccacagatagacaagtaaatcacagcaacaaactaggcagtgtaggaaaagctcttaaacacacatggaaacttataaaagatggcagtggcttgaacataggtgatgagagggatagttctagtcaataaatgttgtgggaagaacggtgatcctcaaagaaaaaaagaacatctgatccctgctttagaccatatgtaagcatcaaatctagaaggaataagcagtaaaataatagaacttttagaaggaaattaggataacatatttatgaccttggggtagataggtttttttaaaccataaacaaaaagcaaaaattataagggataagatggataaatttggctaatgagatagtctctcatataacaacacccatctgtacaaataactgccaaaaggttactatctggaatatataaagcactactataaatcaataatataaagacaaacatttcaccagaaaaagtgaactaaagattcatacaaacaagggaaaaaccgaatatggaaaccaaatagccaagctgtatataggaaaaagtgttcaaccatattaataagtcatagatacacaagttaaaatacaacagcattccccacccattttgtgatgctgatttttgctgaataggtggagaaaggcatactctcacatactgctggagtgactgtaagttggtgtgattcacttgaagatcaatgtagcaacaacaaatgaaattgaagatgtacacactttatgacctagcacttcaattgctgggtatttaccctcaataatctctcctacatgtgcacaaacacactcatggcagtgctacttgcgcataagggaaattggacacacattccatgacaaccagtgaggggtaaacacataaacggtggtatagttacataacaaaatactatatagaaaaataagttattgaatttagtttgaataaactgaatggaccaaatctacacatatcagcatggataattctcaaaacctgatagcttgaaacctttttttgaaaatacttcaatagtgtctgagactttttattcccctacatcagataatcctgttaagttattgtaattaaatcgatggtggttgcacaatttataggtccttcagatcgtaattttaataatgttatttttaacattattaaagaataataataataagtgacattcattaagaattggccaatagatagtatgttaaatgtatttcaggcattacctaatttaatcctataataatcccttggttattataatataattatagatgcgattattattcccaatttacagatgagaaaaatgaattaggaaaatggtattaaataacttgttcaaggtcatataaaaaataagtgatagaggaacaaatattcaaggtcaagataggggcgtaatataaaatctaatacaaggcttctgatattaagtccattggacaatgtgttcaccagagtattattttaatgagatttttctgataataaaaaataatttggaagtcacagataagcacaaaaaaatgtaaagaaaccataactctaccacttggacaatacattttaatatttatgtgtttgcttttaattttttaattttagcactatgtgcaagtagtggtagggaaaatttctaccccaagaaataacttaattattgacctattctgatctatttctggagtttttggaaaagtttgaactcttcatatgctggtcttgggagaatatgaaggcatgatggtaaacagaccttcactgaagttctagccatctccccggaagaagccacattgctgctgtcttcccaagttattaaaagtatggctgttaaacccaatgggttcccaatgaactccatcttatacttctcttagatagggggaggcttttaatacctttctcatcctccccctaccatcctcataccaacctaggggagtgaagttacccatcagggcataagtctcggtgtgtcccatacagcacataaatacaggacatctgctcagagatggggtcactgcatgataaaattccatgcatgcacctatgattctttcatttcttcttctacatggtcatattgttaggtgtattcacccgccttgtctagaaaacacttccaggcattatctagtggcaaatgatgccctgcaaggggacatttccaccaactgggtctgttcacaaatgtgccacaaattccacctacaactccaaaataggagtccaaaaatagttgaaacattggcagcctcactgagaaggagagtggcttcccgcaggggccgcttctgagaagacaacttcattttgacagatttgtgctggtgtgtctgttaacaacatagtcttctcacttttcaagcttctccaggatttcccagggcttggagagatgtttgcacaaactagcttcccgagataaatcccaagtcacgtagccagggcttggcatcaaattgaaagacagtgcaaaggaaattaattaaaatctggccggagggatccaacagaagcagacatttcaagtggaatcaatacaaatgtaagcgccacaaaggctgtgactttttgcctattttattcacggctaaatctccaaagctagaaacattcctggcacacagaatgtgattaataaatatttgaatgaatgagctagattcagttcattctgcatttgttgaactgctactgtgtgaggatttgggagctggatttacaaaggtcccagactggtggaggaaagaaatttaaaacaaaaaacaacaacaaataactatataggatatgttaaatactgtgataaaatgtgtaaagtctctgggggaaacgtgaccaagatataattaattgtactggcaaaggatggagtagctgcagaatgaaggtaacattctaggacttggtagtgttagcaggtagtaggagcaaaagggctttccaggtggaaagaggatcacagacaaaaatatggaggtgtgaaaatgagtggtgtatttagggatcacctcatggagttaaaaaagcagctaccaagagcaagggcaaggggggccctccctcaacagcatgcagagacaccgtttgttttgttttgttttgtttttaagagcatctaccaacttccaggcactgtgcatgtttagtagtagagacacaaagcaaacagcatagatgtgcccttggccacaaactatttacaatctgataatctgcagtgagacatgcatggccaaggctgctatcttattcttctttgtatttctgaggtttcaaatggatttggcacaaagcaaatactcagtaaatgttggatgaacaaatgaacaattcagagcagtttgctaaattggaatgacaaataaaaatgagaggcaggcttaggctatactttaatgcaaagcaaaaaagcagagaaagaaagagaagtagcatgagtttgaagttaactagctcaggttcaaattctggtcctactaagtgtagatgacctataagaaaatacttgaaatctgtgagcctcagtttcctcatctgtacctggatcatcaaggccagaacagccagacacataggcaaagctctacctaatctgttattaggggcacacactctgcagagaggttttagcactctgaggcactcagtgcttaagaacatctttggagatagacaaactcagtttgaagtaaagctcaaccactgtcagactgcacaacatcaggaaagctatttaagttccttgcagctcagtcttctcatctgtgaaatgggaataataatagtatctacctcacagggctttgaggaggattagaaaatataaagttggtgcctagtacaaaccaaactttctaactaaatggagcttaaattacagttgattctaggtgggcttgatatttgatattttgaccactaaatggtaatacccctacaacaaaattctaggtgggcttgatatttgatattttgaccactaaatggtaatacccctacaacaaagtaagctacacaaacattgtgttttgtattgttatgtatcaagctatagcaacttagcatcttagaacaatagacaaatattatcttacagttctgtgagtccagagtctgggctgagttcagctgggtccaggttgcaatcaaggtcagtcagggctgagatttcatctgaggctggactggagaagaatccatttatgtagttgttggcagaattcggtttcttgctggctgttggccaacagctgcccttagtttctcagcttctggctttctccatagggcagctcacatggatgagaatctctaagcaagatgggcctgacaatcctatgtatcaagtcatgagagtgacatcccactaaccttgcagtattctgtgggttaaaagcaagtcacaggtcccgtccacaccaaggggaagggatggcacagggcgtgaatgccaggaggtgaggttcattaggagtcaccttagtctgcccacaacaagtgcagagtgtctttctctcttgttcctcactggattatcagcccctagaacagtgcctgccgcatggcgtgtcctcagtaagtaaatgtattggataaaagaatgggaagatcataaatgtggtttctatagtggtgtgtgtgtgtgtgtgtgtgtttggggaaaaagaaaggagtggatgactgctacattctgaattaagctgagagcagaggtgatgaagaaaatgtccaggcaactaaggagtggtgttgaagttgcccactcctacctttggctgatatgagtagccacactgaacagactgagacagagccaaattgcaactcctacctttccctgggacctctggggtgttcagtagcatacaccaaaaggaaaataagatcctcattgtggacaagtgctcacaacctttaccatgatcaactgtcactctccttccttggggtatgatcagcagctaatgctaccctacagcacatcattcgaccttctcctgatacacaaggcaaatactttcattaacaaaattaaaaaagagtaaatgaaaatatctcaaactaaaggaagagaaaaaatataataaaaataaaaggaagtcacctgaattaggttttcagaccctcaaaggaaacctttgttgtgaggaaagactcagcctctaggactggatctcgggcaggtcagggggaagatggagctcggagccagaatccctgtgggtttggttgtgggctcctgggctcctgctccatactcatgttaactgtgtctgaggacagagtgggttgccatataagctggtaggaggcctgtaaagagaggcagcatttaagtttatggacaaataaactttatcatgaaatgaacatgtgcctgaaggtggcaaaagctctgcttttctttctgttggctgggatttgagggaagggctttgcggatgaatggatttaggaggcagccagatccacatagccccgaagaggtgcagatactgcccaaactgcacctctctgcgctctgagtgcacccaaagcccagacaatggcaggcagggccgaccagctccttacaccacacacatgtttcaaaggaccttgggagcaggttttcatgggaggggcaacagcaatgcttggatggaagaagccgattgaaatcaatgagaattgatttagagtgtgggggccaccgtgttaaaatctcctccctcttgatagcgcttcatgaatattaacaaggttaagatcaataatgagctgattttcagatgcaaacctgacttcatctgcagattaaaggaacggaatgatggtgtttcttcttgcactgctcccacccatatcttagtggatctaagaccccaaaacccaaatgaaacctgcaaggtgcaggtcacttcatgcattgtcacataaaagtttgttgtacatctgttctctctgtgcttagattggaggatgttggatgttctgtgttcaaagcctgtatacaaatgcatgtgtgtgtttacatgcattcattcatttattcataaattttgtttccatcagttttcttcaaccctattcttgatctttgtcatatctcagcttttcccatggactcgtaattggtttcctggatttcagtattgttctttttcaaatcaccctacaaaactctataaaaatggtttatctgaagatctgattcaaacaagtctttcttcggctgaaaaatctgtccaatgttccccattgcctgcaggatgatgtcctaactccctagtagagacatgtcaaaactggggtttagcctcaaactgcatgtacactcccacaatgtgtgaaatgtctgcatttcagctggggcctaaaggatgagaatagactagttccaagaagacacagaggaagaacattctggacggacattacagaaaatttaaaggcccaagatagaaaagatcacagtattttagagaacagaaagggaccaagggtatgtgtgtgtgtatgcgtgtgtatgtgcgtgtatgcatgtgtgtatgtgtgtgcatgtgtgtgtgtatgtatacgtatgcatgcacatgtgtgtatatgtgtttgtgtgtgtgcacacgtgtgtgtgggtgggtgggaactgatcatttagttataaatcacccttcaccctttcctatttggctgttgcctgaacactcttccaggatagactgggttaggaaagaagattctaggcatttcgtgggaggtattaatcagtgtaataattgtggtgcatgttgcatactgggattagatatttttaatagcataactaggttccctcagtgtagagggaacctgggcagaagctaggagcccaccttagctcacggggagtggcagcaagaattctgagagtgactttcctccctggtgtagactctcagacttcactcttaaacctgcgctaagacttggctgagggttcactgacttcctctgtcctgttagagagcctaggaccagtgctcctccccgtatttttgaggagtcaccttctctggtgcctttgagtgaggtcagacacttctcggaacaccacttatcgagaatttcccctgccctgagtgcagacagggtcatgcccatttagctgtttccattaccgcctggcccttcctatcttccactgagatttattaggacctcagaggctgagccatgacctgggcctgatgctttagatacacacagtacatttacgccactccaagttctttcccctctgctgtcgtttttggttccctcaaagttcaaaagtgtggcaggatgtgtcctaccaacccccttttgcagatgttgaaaccaaggcctaggcatcctaaatgatgcccccagtcccacccactgtgaatggaaggtggaagtatgctggattcttctgcctaattaacccacctgtttcctttctttgtgcctctacatggtcccagaattggaaaagtttatggatcatggaaaattggttttcatgtaaatccgtgttccataactcagactggacctaactctcccctgcagttttacagtgggttggcccatactcccattcttcccaagggctacttcaaatcttttttactttcccaaaaccatgcatcctgcttcttgccccttactgtcagcaaatgacctcagctccctacttgcaaatggaagctcccctcaccattcagttagagaacaagccaacaggtctgccgatgccacccctcccctgccttcctgccttccacagcagggcagctgccgcacctgagcttcaggtcccagcccttcccaccctgagacctttcaccttttcattccttgtctttcttgtaaattcaatctccacctctaaccagaaaattctctattgaattctaaaaatgctcaagtctctcctattaaaaacaagaaaacaacaacaaaagtcccacctcattagacctcttcctctctcagcttctgtcctacctctaccacttccatcatagtcacgtttctctagagggttgtatgtgcttactggctccatttttttttcacctcccatccacttctcagttcacactaatctggtttctgttctcatcactcactgaaaaagtcacgatgaccttccaagtcgctaaatccaatagacctttatctgtcattgtcttccttgaacccttcatggcattcaattccagagcacgctccctctctctttcttgaaatactcttccactggcttctgtggcagcacattcccttggtttttctatctctctggaagctttctctccgtctccttttcatgagtctcctgaatactgccattaaatgtcatagttgctcaaggctcagcttgagactctttcccttcttaggtgaactcatctcatatgaccttaatttccgactatcaggaagatagaaatatatttatttgaggaaaaaaaagaatgatacatgttctctatatacgaaactgcccagttgacattctcttttgaatgtcttaagggcaccaaatactcaacttctagaaaaataatgtcaccatcttttgcctcagcttcaaatctggttcccttacagaatccccttctcacactggttgccatcctccagccaggagtgcaggccagaaacccaggaagtcattttcaacacctttattccttaccccatccaattcattacccagtcctgtaatatacattttaagtattttgctaactatatcccttactactattttggacctagaaagcatactgaactgaaagagcagacctggcacaaccagtgacaatctatatgatcctgagctaagctaggcacgtggtgcagagaccagtgagggctattgtgaatagaagctcctgcaggtgaacagggccaagcaggagattatgaaatctcaataatttccaataattctttaaccctaatgatggacttagtttcctaatgtagtttaagggctttaaagctaaactgtccagtccagatttctgcaagtaaaactcagaaatgggtaacactggtccttattggaggctattaagagaaggaaagcagctgccttcgacagaaacatattgacagaaggagtgggagtgtggacctgtaagaggtttccaggcatggtttacaaagtctatccaaaggtcttgtttcacctcaagttcatcaatgcttgcagggtatctttctgtggctgtaaatactcctctgaatcttgctcattcctaacctggagttctaaattcaaagcagttaacccttcaggaggatctgagatttacatgcaaggagatttactggtgagtgctcacaggaatatcagcacagaagacagcagcaggattgggcagatggaggagctgaacggtgctgtcattgcaagagcacttcagccaaacacacagggatgctgtgatgaaccccagagacttcctgaattggagcaagggaccaagcctttgtacctgctgctttggctattaatggaggttaataaaggttgactctggggaaggggcttagtgttgagttgggcaggttcctttagtcaatggcaatttccacagaaggatgaaggtatgtgagcagtcgggagcctcacacctggaagctgggtgaaggactgccttggtccttgtcctgaagaaggatctgagtgctgcagcacagcatccactgtactcacttggccaggtgtatcatgatctgctgctgttccctaccctgtctttccttctttccttctcctctcttatgaggtgattcataaggaggctccagaccttgcttttgccttttttttccaattagaattgcttcccttcccaacctgtagcttcctcttcttcttcactctcttatcttacacccttaaccaaactccagatccaacctgaacacacctggcacatcactcatggactcccacacttctctctcactttcttcctttccatgcccctctaactgtctctatctctctatctatcatatctatctatctatctatctatcatatctatcatatttatctatcatatctatcaatcgtcttctctatctatgtatctatctatctctgtcacatctatccatcatctatctgtctatctgatctatcatatctatcatctctattatctctatctatcatccatctgtcatatctatcctatctatttatcatctatctatctatctatctatctatctatctatctatctatctatctatctatctatccatccattatctctatctatctatctatcatcatatctatctatctatctatctatctatctatctatctatctatctatcatctatcaatctaggtatctatcatctatcctctctctctctctctgtaaatatatctaacttcaagcctatctcaggccactttattaaaatatcagtgttgtagctgagatctgagtgaagatcctactgtcttcactcagctgtggtggtattcctaagagcagtcaccaaataaaccttgcatgtaaatatcatggtatatgtaattgtcattattcttttaaatttagtttaatcacacagctgataggctttcagtttaaaactcttcaaatgatacacagcaaaattcaccacttaatatcccctccacttcttgccccagaagtgattcacttatcaattttttcatacataaatatatataaaaatgcatatagatgtgtggtttacttctgtattacattggacatatgccttgctacattctttactcacttaacaatatattgacaatgtatgttggggctgactagtaccagcttgtgagagccgactgtgtggatctcttcccaactccactttcagtatcatcacatgggtagcctgtgattggccatggtgggagtatttacaccacagaaggcagaaggcagcaaaccctgccaaccagtgtctgtcctggagagccggttgttaaacatatactagttcactgctgattgtagaatcgtttaatgtccatttgtatacatttattttgtcttaattcttgcaaaatttttaacattatgaataaatacagtttagccagtccctgaatgaacggttttcagattatacccacattttcacttgcacacacaatgcttcactgaatgatattttcatttttggacaagtctgtatttttctcgtaaagttacttagcagttgtactcttgggttgaagcaaatatgggttttatatcataatagacaaggctaacctgtctttcaaaatagccactaatttacaccttatcgatagtatgtatcagtaccattgtgatacttttgtgatactgccagtctttttaataattgcacatagccaatcttccaacttgtagattccttaggcagataaagggaaaactgctattgtactgaagtattgctattagtaaaaatatcatgataatggcgataacaaagatgataatggtaaaatagttttaaaagtagtcatgcataattatgttttcaaatatggctgctaattgcgcaaaaaaactgatattctaagtttttatcttctttttgcaggagatgtggctcctaaaatcatggaaaaaattaacttggagtttaggcttgtgccactaccctgagtgattcaaactattattgtgcggtatataattttttgaccaaaaaatgttaactataactttttacacagggcatttaatttaatcacggcgacctgaaatcatagtctttccctgtaatggttttaaagtaccattccagccactcaggatgaagtgctcaggaataattcaggtgcctcatctaatgccctcacttatagacctccggcagaaaatggggattctgcagtttgtttttactggctgtattgatctgatctgaagaatttcttcctccacagctaaatcagtaaattccacacttagctggcattttgctccagtacttatacggagagttgaatttggagtcatgaaacaatatattgtcactgttactgatcctggcgcattgctattaaggggagtctataaaattcttgcctgtgtgtggaaaatcactattgccaaacatcagggatgagataagcctcttgaaaataagatatgcctgcttatattccattgtatatctctctagtagcctttggtgtgaatcatgttatttgagggcatatttggctttttcaaattgttaatgctcgtggaatctttcttcagagatcaagttttaggctttttgcttccttttcaaaatcaggggctactaatgttaaatggactttatatcataagagctaaacatgattgagctcttcctgtgtgccctagtgtgtggtaggcactttttcatcattatccaatttagtcttcacaactaccttgtggagtagatattattattactcccattttacagatgatgccactggagcttagtggattaataaaatcacacagctagtaaatgatagagctcagagagtcaaattcagggctcttttctttagaaacccagccctttcctgaggtgatatcctcgaattaaattctttttttggggagggccctgattggtcaacacatcctttgatgggcagccagctgggcagtgatcaagagtggaagcaagaggccagagccttaagttggtagaccacaagcccgggaatgtgtttcctcttcctttgtatttcagttaggagactgtaaggctggcccactcctcatcccttccaagactccacaaaaactagctcactgatcatgtctgatttttcaccttaggtaggcaaaaataaatttttagagaggaaaaagaaaaaaaaatacacacacacacacacacacacacacacacacacacacatccccaataagcattaaaaaatagcatctcagggaacaaaggatatgcttgattctacaggcattccagcttaaaggaggtcttgttctgttaaagcttgcagaaaacaaaagggctgcagctttcctggatttgatgtttctctctagaggagcagtgccattcaaactaatcaaagttttactgggttcagaaatgccaaaccagcacattttgtattcctattcccccaaaaacactgtctgcaagtgaaaaacatctgcatctaaaacaagacaattaacaagaagacacgcgcgaggctgatgctaatgctgcggtctatttttggttgccagctaagtgaggtgcagaagcagagaaggagagcgtgcctccctctttttttatttttttcatttttattttttaaactgcggtcaaatgtacataacataagatttaccatttgcaccatcttttaaatgtacagttcagtggcattaagcacattgacattgttgtgcaaccgtcaccaccatctgtctccagaactttttaatcctcccaaaccgaaactccatactcatgaagcattaactaactcccaactcctccctaccccccaactcccagcaaccacccttccactttctgtctctgaatttggctactttaggtatttcctctaagaatcatacaatgtttgtcctcttctggctggcttatttcacttagcataatgtcctcaaagttcaaccatgttgtagcacgtgtccgaattttgttcttttaaaggctgaatgatattccatcctatatatgtaccacattttatttatccattcattcgtccatgggcacgtgggttccatccaccttttcactattctgaataacgctgctatgaacttaattgtacaaatatccattgtgtcccattgtttccctgctttcagttcttttgatgtcaagaagtggaattgctggatcatagagtaattctgtgtttaattttttttttaggaccggccacaccagtgagtgagtctcttaacctttcttaagcctctctctggctaagctcaactcccttggggagactctaggggatgccacctgggagggcattgtggtggagggggtgacactccaaggagtcttcttggggaaggagctgagtgagaggtggtcctcatgcacctcatgcagaagatacctttagggaaagagaatggctatccctggagacagggattgagcagcaactgaattcatagacaatttttggaagcctgataaatgccaatgctaaagatgtcaaacaggaagaaaaaaattttgtttaaaacaaaggttattgcattatatttaaggacagatgctgcttttattttaggaaactcaaggatgatggctgtaataggagtatgtttattttagttaggttccctgggcaaagcctacatgggtggggataattttttatatttctacaggtcaacgaggagaaaagagttaatgagggcaggaagagggaaaagaggagatgtgagaaagattgagcaagtggagaaagcccaagaagaggccaggaggtgagagtctcaggagagaaagtgggccattgagaagtccctgagtcaggggtagctaaggaatgctgctgggtcagtaagaaccaacctttgacgtattgtttcctgcaactatatcatctccttgctttcactgtaaaccttaagtgaatgcttgctaccgcaaatgagcatcgtgttactaacattatcaggatttcatgaaggaaggggttggtgtttggcttaggtgagcttcccccagaaggagatgctgtaacatgcgtttcagtgaagtagatcatctgggatttggggagcacctataagggagcatagaagtgagataaagggaagaaaacgattcaatatgagttcatgaacaggttacctctgtgaacaactagggctcagtctccctggaactctctgcaaggctgtgtagaacaagactcagaattatccctggggcaggaaacggagggcgataactacttaaagtctaggtctcattgctttttagaatgagggcaattactgatgctctgatgggtgccttggagcaactttgtgagcaaatgtgcaaagagtaaatgttgctggggcctaaagatgagcaaggtgaatgcatccttttcctgtataccccactggcagacaatcatgggctgagctttcctgtttgtctccctaagccagctcccacctctgatctttcaaccattggacagaaacatagcaacaggaaggaggaatatagcaataagaatttgttctaattcttctctctcaagaagtattttccataagatagaacgctattgacatttttagacttttatttattggattaatctctgatttatcattcagtgtacttttctgtctgctatggaaatgatgaatgatgtcataattataattttaaacacttcaaaaaacatctcaaaaaatccacctttcctctccatcgcaaacaacattctagtttttgtacattccttttagctctagcactgtggataaattttacataatattaattatggcctgcaaggaattttatattctgctttcatcaattatcttttatcatttagatttaatttatattttcttcagtctttatagataatgtttgaatagcaacaaagtatttcatccagcggctggacaataatacatttcactagtcccccatttctagaaatggatgattatcccagattgggttccaaaggaagtgggctccaaaacagacacttgcagggagatctattacagcgtgctcttgaggatcaatacctgtggaagtcaggtacagacagcacagggcaagagggaagttgatctctcatgcagttattatgaaggtgttagctcagcccaggaagagctttgaagcagggagggtcttgcgaaattgtgtcaagtttgggcaagcagacagggccttaacaccatcacattgattagtcactggatatgggctataacctcaggcaaggcagttttcttcaggccaggaaatttccaaagaggtagatagctgagggctgtcttacaggtccctcagagcaatgtgggtagtgcatcagtgcccagcccaagggcattttccagtttttctaattaaatatcacagcgatgagcaactttggacagaatgtattttccactacttctttctggagattctggacaaaattcaaaagttgaaacttatgtgtttccagctctgggaattttgcctctaaaatattttctgacactgacacagttgctcaagctcttttgtttccctgatttctaaaatggtgacaccaactccagctaattaaaaatatagtgggaagaaaagtaacatcatatgtgtgaggcattttgaatattacaaatgtttttctcaaacttacattggataatggttgtaaaatacagattctcaggttcattccctagatattccaactgacaacatttcagggggcctagaaacctgtattatgaaacaatataccacacaattcttatccctgggaaaactgagaattgctgctttagaatataaaacttgatgaatccagcatatttgggtattactctgctgctcttttagaaggaaaacaatttgcatcctgtctcctttgcctgcacccttcatcaagtccactctagtttcagcacactcttttgttatcctgtcacttaaccatcttcttgaaataattacagtccaaactacaaatgtattttcacatgagctcttaagtaaacatcccccacttatgactccctgctggacattcactgagacccgaaattgtggaggccactgtgtcaggcattttctatacatgatgccatttaattcttttagcaacacctaaggtagattttatcatctctacttttccatgggaagaaaaggactgttttggaggttgaagagagtgtccaaaggctcgatgagctattaactcctccaaggtgttaggtttggcagtcactcttaaaagttgtaaagccaaactctcaaacattcctcataaactcatgggtatctgtaacagaagactttttcagttgtaagtcacacaaaacccaatccaaactggcttaagcaaaaagggaatttattggctcatgtaactaaaaactctatgagtaactggccttcagatgtggctctttgcagggggtcaaatgatgtcatcaagattttttttttgcctctcgacttgagtaactgtgtcttctccattgtttccattcccagagagactcacctcctcttgtaaagtggctgctatcaactccttccagctttatctccaatggaaaagagtcttaggcagtcatagtcacaaggtctggagaatttccatgattggagatacttcagacatgtacctaatattaactgttgcctggaaaaaagacaacttgggtcatgtgctcactccctgttcctccaaaaacttgaaaactgagtggtggaggggcaaatctccaaactaaaatttgggctgttacacaaaaaacaaagaatagatgctgaggagccaataggtaaatttctactgctatatcatcagctttttcttcactttccttttgtattgagtcttgttaaatatcctctaacagcctgcctagagaattcaagaactgttccaaagacttcatacactaacttagcaatgacttattagacacgtactgttattgtctctatacctacacacagatgaggaggcaggagcctttgttaaaggtgaaattggaacacaggccaactggctcccagatccattctttttcccaccaccgtctatggcctttaaaaatcatacgtcttcgttgtctagagtcagtgtaatgccatgggcttcacatgatctctttctgaaccactcctagatagcatccagcctcaggtctcttcccctccatctatctaacctacacatcttcctagagaatcacacccacgctctctcacccacacatcatctgtagacaccagccacatgcctcgctctactctagatacttgggagtgggaatgaggagtatgtgttcaagaagacagtcttgattcttgctcaggcagagaccatggaaaattaaacagggaattatgaaataattcacatgccttcatattttacctagggacaaagcatcaaatgaataaacacacatagttatgtactttgagtgtccttctgtcagtgttattcatatactttaagatgagctggctgagggattaagaggcagcttttatttctggtagcttatagatacaagttctcagctgcaaagttctggcttgggccccttgtgagttcttggactgcatgaaacttaaagcatgatggtttttcccagtggtcccccagatgtgctagagcatctctaaggtatatatgttaggtcttttcctaggggatcccactatggttatgagagtgaaaatatgtacagtatgtcacaaacaccagctgttaccttgcaataatggcatttctctctggagctgatcctggaagcagagaagtaacataaatcacactgggaagagccttggactaggagtcaggaggtcagcattacagctctcctattgccctatgtctgggtggtctctataaaagtctcttctcttaaaaaccacatgattacctcaataggtgcagaaaaggcctttgataaaattcaacatccttcatgtaaaaattctcagtaaactaggtactgatggaccatatctcaaaatagtaacagctatttatgacaagcccacagccaatatcatatcgaatgggcaaaagctggaagcattccctttgaaaaccggtacaagacaaggatgctccctcttgccactcctattcaacatagtattggaagttctggctaagataatcaggcaagagaaagaaataaagggtattcaaataggaagagaggaagtcaagttgtctctgtttgcagatgacgtgattttatatttagaaaccccatcatctcagcccaaaactccttgaactgataagcaacttcagcaaagtctcgggatacaaaatcagtgtgcaaaaatcacaaacattcctttacaccaacaatagaaaagcagagagccaaatcatgaatgaactcccattcacaattgctacaaaaagaataaaatacctagcaatacaacaaacaagggatgtgaaggacctcttcaaggagaactacaaaccactgctcaaggaaataagagagggcataggaacaaatggaaaacattccatcctcataaataggaagaaacaatatcgtgaaaatgaccatactgcccaaagtaatttatagatccaatgcaattcccatcaactacctttgacattctcaacagaattagaaaaaacaattttaaatttcgtatggaaccaaagaagatcccgtatagccaagataatcctaagcaaaaagaacaaagctggaggcatcatactacctcacttcaaactatactacaaggctacagtaaccaaaacagcatggtactagtaccaaaacagacatatagagcaatggagcagaagagagacctcagaaataacaccacacgtctacaaccatctgatcttcgacaaacctgacaaaacacgcaatggggaaaggatctcctattcagtaaatggtgctgggaaaactggcttgccatatggagaaaacaaactggatcccttccttacaccttatacaaaaattaactcaagatggattaaagccttaaatgtaaaacccaaaatcataaaaaccctagaagaaaacctgggcaatatcatcgaggacataggcatgagcaaggacttcatgacaaaaatgacaaaagaaattgcaacaaaagccaaaattgacaaatgggatctaattaaactaaagagcttctgcacagcaaaagaaactatcatcagagtgagtaggcatcctacagaatgggagaaagtttttgcaatctgcccatctgacaaaggtctaatacccagaatctgcaaggaacttaaacttatttataagaaaaaaacaaaaaaccccatcaaaaattgggcaaaggatatgaacagacacttctcaaaagacaacatttatgtggccaacaaatatatgaaaaaagttcaacatcactgatcatcagagaaatgcaaatcaaaaccacaatgagatacccatctcacaccagtcagaatggcgattattacaaagtcaggaaacaacagatgctggcaaggctgtggagaaacagtaacacttttacgctgttggtgggaatgtaaattagttcaaccattgtagaagacagtagggcaattcctcaataacctagaaccagaaataccatttgacccagcaatcccattactgggcatatacccaaaagaatatatatcattcttctataatgacacatgcacacatatgtttattgcaatgctatttacaatagcaaagacatggaaacaaaccaaatgctcatcaatgatagactggataaagaaaatgtggtacgtatacaccatggaatactatgcagccataaaaaggaatgagatcatgtcctttgcagggacatggataaagctggaaaccatcatcctcagcaaactaaaacaggaacagaaaaccaaacaccgcatgttctcactcataagtgggggctgaacattgagaactcatgggcacagagaggggaacaacacacaccagggcctgttgtggggaagggggttggaagagggaacttagaggacaggtcagtaggtgcagcaaaccaccatggtacgtgtatatctttgtaacaaacctgcacattctgcacatgtatcccatttttttagaagaaataaagaaaaaaattcttcaattaaaaaaatctgtgattaatatgaaaaaaaactcttgtcttttctacatctcaggcctcccttttgcagagtgaagggattgaaatagataaacatgaagtgatattacccactgtgccaagattggaggacaaagaggcactggagaacattttctaggttcttagacaagttgtattctgatcagggcgtggaaagttatgacagaattttgttaggaatgtgcatagaaagacatcaggacaggtgccaaatctaggaaccaggtgttcagaacagactcaactatccatgtctcaggactgatcagggatgagaggacattagagagaccatatgatggcatcgaagtgtggccagaagccatatgcgtcttcatgagcctgcatctcagggttaattcttccaagtcctgcccttagtctgcttcctactaaggactcttcctcctcctttctctttcttggaatagtcccaggactttattgtctcacgagacagagactttgccttcttcatagctttgccacaggcagttgatcaaattgcatggatggggaattctggtccttattagaaaaacagagaacttctcccagatgtgacaaatgttacacacacttgctctcattccttctccctgtgtctataaaaacatcactaaccaattactgcttctttccccttgggcttgggcatagctttagggtcttcagcacagtcttccaaacagctagtaccaatccactaaagatggcacttaagatgaaactgattgctcaaactagcctccaggttgtctcatcgatagttcttttgagaatataaccttagtatcctcccatggtaagtggcaacgtggtttgaagcttaattttcagataaataatgaaataataggagctgtaaagacagatagagatagacagaaaagttttaggtacactgcctacagaagagttgggtaactgagcctatttaaggctggaactctgggtcatagactgtgagcataggcagctgagcagatgtggccagggggttccccatttgtatctgtctgggcttagtacaaatggacttccacatgtctcctagagtgtctggtgtctcctagagtatcgtttcaacttgttggctttcattcagattggattttaggtacagacaggatcgtgtctacccatcctatcattattatattctaccagtctattaagaattgataagtaatgggctggtcctgtttccagcccacttcaatcatgtcttagtaatgggggtttccaaggaaagaattacaattgagtaagcacgtgacctccacattcatatttaatcagatgccagaggaccttgggcagatctcaggttgccaggggttctacaagaaactgtagggtcttgactcttaaagggacaagtttcgtcctttgttggaaatacaataataacaataaatgcaagaaaagaagatacagaagataagacattggcctgatgttttagtagagatctggcttaaggtgaaagcagtacagactgaaaactttggtgtgaagttaatcctttagtttcatgtatctttgaaataacatggaaaatgtgagcctcaacagagaaccctgagttgtcaccatggctgtattttagagtggactattaattttcctaattagagacagtgcagtgcagtagaaaaagatgtagggtctgacatacctggattttaaacttaactccatcccttacaatctatcaacttggaacatgaacttactcctcctaaccttcagttttctatctacagaaaatggagcaaattgtaattgtttgtactgtttaaatggcatttctctaggaagatggaagaaccacagtattatatatgagcgtatagagatctgtccataggcatcaggcacttttaggtcacctgtctttagccctgttagaacagcatcttagaccagcaaaatcccagacactgttcccacctgggagtctcacttattcccccttgtgaagggtaattgtgcttgtacagccggttcagcctttttctatttagccagcactcaagtctcaccagtgattctcaggaggccagcaatgaatattgtttaaatagaaaatgttgtttgtgcatgcagtgtcaatgaagatgttattaatacagctccaggaaagcagctgctgccaaccggctggagaagccacagccccatacagagcctgtcccacaatttcagggctgagaggcacttaaaaggcatcaggtctaacctctgtcctatgaccatctgacctagataggctccagcagttccaagggaaggacacctaccaaccatcttaacccataatgtggtttttccatctctggataaatctgttcattacaacttttgtgtttgttttccagcattggcctcaaatttgctttttaagaatattctctcattgatgataattcagatccttgtgactacacggtacaaataaaatatcccttccttgtgacagttgtggcttcagggaggtgtctctacttgcaggttaagccttcccagttttcccaaggatccttcagatatcgtggctactgacctctattgcgtcagacccatgtcccagctccaccttggactagctggctgtgcagtcttaggcaagcatccttatctcacccaaaccccagtttcctcatgtgtgaagcaagaaacacgcatgggtatacatttacttaaaatagtatggggcttgagggatgtgaaatttaaatgagaacagttataatatgcttgacacagtgcctggcacatagtaggcactcagtaattatgagtgatcattattgttgttttatcattcagcttggagcacagtaccctaggtgcgctctaattaacccataattgatcagaacaattaggtttcatcagagcctataaaactattaaatgagctaggtcctacttacttttccactctcacctctcacttgtcattttctgtgttggccataccccatctgcattggtctccttccatttctttgcataagccagaatctgtcatatcttgaggtcttcacacatgctgtcctctcctcggggcatgctttctctttccatctggatgcacacacttttcacgatttccctcttttcaaggtcatctagtttttcaaaacgttacttcccaaaagaaactttccttgatcactcatctaaacagccttccccaatacatctttcacactattccctgtctttgctgctcataacattcaccaaaatatgcaattatatattgacctgtgtgttcaccttctataatgtttatctttgctgctagacttagaacatcaacacagggaaacagtcttttttgttttttaaaaactgtttttctctacatgttataatggtaaatggtaaacatatagaacagttgaaaggattgtaaggcaaactcttatgtacatattccctgtattaaacaactaacactttgctgtattatctttattgcacatttattcatctatccatccctctttctgtctgttcatccattcattcttttatcttatttcctaatgcatttcaaactgagttgaagacataagtacacttcacccctaagcacttcagcatgtatatcattattaaccagggatcaatattcatttatgattcttctttcttgggttaaaatggacatgtagtaaaatgcacaagcgttaagtgtacaatttggtgagttttgaaaacacatacacctgtctaacccaaacccctatcaagatggaaaacattattgtcactccaatgcgttttcttatgccctttcttagtgaaactccaactccactgaccccagaggcaactactgttttgatgtttttcaacatcgatttgtttttccttttctaaaattgtatataaatggaattatagaacatgcattccttttttgtaaaacttctttcactcaacatagtatttttgagattcttccaagtctcagcatatatcaatagatcattccttttattgctgagtagtgttccattgtatggatataccacagtttgtttatttgttcctctgttgatgcatccctaggctattttctatttttggctattatagataaagagattatgagcattctgtgacattctgttacattcatttatcttgttttttggctaccatgaataaagaggccatgagcattatattacatattagtatattcttttatcttatgtaaatacctaggagtggaatgtgggtcatagggtaggtataaacttatttttataaaaagctgctggacctttcttcaacataggtgtagaaagagtctgttttctttagtaacatcaaccagatagtatgtgaatttggcacaaagtaagtgcttaataaatatttgttaaattaatacacagagaaaataaatagaaatatagtgactgttctaatcctttcctactgtttactagtgaagtgtgactgtttacgaatcatttaagttccatgagccttcaatatccttttatgtgggaataataaaatgtgccttagatgcctgaaaaggttagtgctgaagggccaggggcatggggggagattttaggaggtgagggacaccattcatttaatacaagcgtgcccttccttctctccctgacctccccagtctgcaagatttcggcctgcagctgtcagggaatatgccaaagcctaggcccaggaggggtcagggtaggtgaaaggggaagaggcacttggatcaaccattggttgctctcaaatgtctaaagttggcatttatatacttgacttctctcacagtttctctccttcagatttaacgtctaggtttctctgattttaaaactgggttatttgaatgtcaaactttcgataaccctttaatagaggtgtccattaacctgtgctaaattagagcccagcgtccctggaaatacatgtgacacccacatgaataccaaatgccttcattaggcacagcacttacatgatgaataccaaatgcagagcccaacgcagggacacagatttcgcttcgaggacttgccaacacatctttgcgtttcctcagcggtaccggtcagccctgtttgctgtttatttccaggtgatgagatgtggcaattgtggcattggctgaaataaataaatggcatcctaatcaccaagttcagagatggagcagcaaaggaggctatagctgatcactcaggagtcagcaaaaggatgcccacttagtatgcaagacgacttccaaacacttcataaaaggcgataactttctttgaccaaagaatatattatttataagtgattccaatgccttcttctctccctccttcactgccatcctcctgccccccattttcactgtatgttgtagcacttgttcagtgatgaagcccctcgtaataaataatttataaagcaatttacaagtacattattcttagcaataagataagacctggaagaaagtgttttactgatacacacacacacacacacacacgccccttggcttataagtagcaagctatcagaacaccaataactaaggtccatgggcttggggtgaagggtgttataagccatagtgctggagcccttatacataagccatgtaaagtgtctgaagtgtatttgcataataaataagagaaaactcactaaaaacagccttttctcttaatccttgtacacagctgccatggctttgtccacatggcgtgatactaagtgaagacaattttcccttaatggctaacttctcttgagtacatccattgagccaggcccagtgttaagagttctcaataaattgtcttattttatcttccctatctctatgagatatgttttattagtattcctgttactggacaaagtaacagaggctgcctcccagtcttcaacattcagtctttgaattcccaatccagttaaagtcactcactcaagtattcattcaatgctaatatcctacaggcatttgataagcatctgtcattctttattctgggagctaggatgcatagacagatgatgcatctatagcagtactgcctaatagaaatacaatgtaaatcacaaaggcaagctgcatataaaatttcaactttccttttttaaaaaaaattagttttttggttaaattaaatttaaccaaaaatttggttttggtctgttgcacaggctgcggtgcagtggcaccttcatagcctcaaactcttgggctcaagtcatcctccaccttaagctcccaagtagctgagactacaggcgtgtgccaccttcctggcaatatatgtatgtgtgtgtgtgtatatatatatatatatatatatatatatatatatatatatatatagagagagagagagagagagagagagagagagagagagagagagagagagatagatagatatgggggtttcttttgttgtccaggctggtctcaaactcctggcttcaagcaatccttccaccttggtctcccaaagtactggggctataggcatatgtcaccacatctggatatttttttattctttatttttatttattttattttatttctttatttttgagacagagtctctctctgttgctgaggctggagtgcagtggtgtgatctcagctcactgcaaccactgcctccaaggttcaggcgattctcatgtctcaccctcccaagtagctgggaccacacccatgaaccaccatgcccagctagtttttgtatttttagtagaggcagggcttcaccatgttggccaggctggtctcaaactcctggcctcaagtgatctgcctgccttggcctcctaaagtgctgggattacaggcgtgagccactgcgcctggccagtatgtatactgtttttgttagagatggggtctcactttgttgctcaagctggtctaaaactcctggcttcaagtgatcctcctacctcagtctcccaaagtgataggattacagttgtgaaccaccatgcctggttataatttcaaaatttctggtagtcaccttattaaaaaaaggtaaagaaaaggttcaaattaattttaatggtataatttatttcatcaaatatatcttacattcttctttcaacatgtactcaataaaaacattattgatgagatactttaaattccttttcatcctgtcttcaaaatccagtgtgtatttttcaccctgtcttctaaatccagtgggtatttttcacttatgacatatctgaagtcagactagccacatttcagggactcaatatccacctgtagctagtggctactgaactagatggcccaggtttataggaaagcgaaggaggcagatgcctgggatgacatatcactagactatgacaattgcgattagagaaatcagcttaagctggggacaaaggtaatgaaaaaggccactcaaagactaggaaggaggaatccacctgaaaaagagtagaccaggctggggttcaggttggaaagcttgggccaaaagaccagcattctcctaacttcagtcattccctcactcccctagcaaaagttatttgctttctctgcttagtatttgtcctcctgtttacttacttttttttttttttttttttggtaaattgatttactttttaaacttaaacaaatttatttaacaatgggactttttggtacttccgttaatgggaaagcaaaattgactgttataaataaattagccacaaaacaaataccaagcaaacaaagcaaagttattgaattctagccatatttacttgcctgtgcaaagctttgggtttctgctttatcttgtttttgtttgaagagaaagaggagagagaatctctgttttgggcttagatgtattaagggctgcatttattctttctactaaaacaacccccataaaacccaaacaaaatatatgaagtaatggtttaaaagacatggaaaagcaataacaaaagcctaatccctggtggtaacaaacaagaccaggcttacaattctagcttcctgtctagtgaataatcagccctatagtaagtactactctaatcgtaactaacaatagaatcaaaacccaataggactaaattgttttcaagaaatttaactacattccagaacaaagataaagaatatttatgaaaatattttttaaaattaccaggctatagtgcagagaaagggaatccaagtggagcctgacaggcccctgaagccaaggaaacagatctgagagatccatgcagatgaaggcagctggtattggcagaacagagtactggggaggcaaaagctgcagagagtgagagaacattgaatatctgcagagggcttctgtcaagctttcagctaacagggattactacatgtgcttgtgaagaggacttagagttaggagtgtcctgtgctcacacagtgttgggaataatgcctgctccaaccagtaagactggaaaacctcatgattcatggggcattaggtaaagtacccaaaagggtcttgcctcagtagtggggaataattagccctataatgactactgctttgattctacctaacacttcttagaagcaagacccaaacggaccaaattgtttccaagtaacttaactgtatctcagaacaaaactaaagaatatttatacccaacaaggtaaaagtgacaacgctatacattaaatcagagattaccacaaatgcaaagtgcaaaataagatccatgattaggagaaaatcaatcaactgaaactgtaccagaactgatacatgttaaaataagcgtaaacattaaaacagttatgataattgtattccatatgttttcaaagataagtagaggcatggaagattttaaaaaagtgaaccaaattggagttctatagataacaactataatttaggaattgaaattatactggatgagattaatagtagattagatattgcagaagaaaattttagcgagcatttacacatagcaatagaaactatccaaagtgaaacatacagagagaaaataattaaattctaaaattatcagtgagctgtgagacaacttcaagtagcctactccagacatgtgaagaggaaggcgtgtttctcaactgattctatgaggccagcattattctgatatcaaaactagacaaagacattacaagaaaaactacacaccaatctccctcataaatatagattttaaaattatcaacaaaattttatctaactgaattgaactctctctctctctctatatataaatagttggagggagatatatacacacattaaatttatattggatatactatatctaactatatacatatttatttaatagatatagtatatccaatataaatagttggctatactatatccaattttacacacacacacacacacacacacagacatatatatatatatatatacacacacacacagaagtccaagaggagtttatcccagaaatgtaacattggtttaaaatttgaaagccaacctctgcaattcgctatattaacaaactaagacagagaaaagtcatatgatcatctcaatagacataaaaaatatttgacaaaatgcaatggtcatccttgttaaaaactcttagcaaactggaaatagaagagaaattccaagacctaataaacaacatctattcaaaatctacaggtgacatcatatttaatggtacaagactgaatgttttttgctgagagctggagcaaggcaaagacgtttgctctcccccttttttcagcattagcttagaggttcttgtcttgacaactaggcgagaaagagaaaatgcatccaaattggagagggagaatcaaaactatcattatttgcagattacttaatcctaaggaacccacaaaaatactagaactcataaacaagttcagcaaagtttcaggaaacaagtcaatatataaaaataaattttatttaatataaaactgttaagcttatggaaaaaataaaggaatatctgcatgaccctggattagtcaaatatttcatagatatgacatcaagtacatgatgtatagagcatattgacaaattagactttatgaaaataaaaaaaaacttctctccaaaaaacactgttaatatagaatcaacaaataagccacagactggaaaaaataagtttgcaaatgactaaggatgttaagcaccttttcatgagcttacttcccatccatatatcttctttaataaagggtctgttcaaatatggctctcttttttactaagctgtttgtttttcccctccttttattttcctttccctcttcctcctccttcttcttctcttcctcattattatttctttattatatattctagataaatttcattatcagttatattatttgcaaacttggctgggcggggtggttcacgcctgtaaccccagcactttgggaggctgaggtgggtggatcatgagttcaggcgttcaagatcagcctggccaacatagtgaaaacctctctctactaaaactacaaaaaattagccgggcgtggtggcaggcgcctgtaatcccagctactcgggaggctgagacaggataattgcttgaatctgggaggcagaggttgcagtcagccgagatcataccactgcattccagcctgggtgacagtgcgagactctgtccccctgccaaaaaaaaaaaaaaaaaaaaaaagagaaaattgcaaattaaaaccacagtaccactacacttttattaaatggctaacctgaaaattaccctatcaagagttggtgagaacacagaggtactggaactctcatacaccactagtagtggtgtaaattggtacaacccctttagaaaatggtttggcaatttcttaaaaagttaaaaatatgttatcatatgatccagccgtttcactcctaaacattttcccatgggaaataaaatcttaagtctttacaaaggtgtgtacacaaatgttgacataagcttaacttgtaaccaccaaaaataagaaataatctaaaagcccatcaagagacaaataaacaaagtgataaattaatataatggcatactactcattaataacaaggaataaacttgatacatgtgacaacaaccatgaatgccaaagtaattgtactggatgaaagaagccagccctccccctcagacaaaacaaacaaaagaggccaggcgctgtggcttatgcctgtaatcccagcacttagggaggccaaggcgggtagatcacttgaggtaaggagttcgagaacagcctgggcaacatggcaaaagcctgtctgtacaaaaatacaaaaaagtatacaaaaaatcagctgggcatggtggcacatgcctgtggtcccagctaatcgggaggctgaggcaggaggtggaggttccagtgagctgtggttgtgccattgcactccagcccgggtgacagagtgagacgctctctcaaaaacaacaacaacaataaacataagaaagtgatttggctgtaacatgcatgcaagggaaggatcaggaagaatggactcacaaagtattttgggggcttggctaaaatgtttttactcaattttggcataagttaggttagcagatgatatggttttgctgtgtctctacttaaatcttatcttgaattgtacttcccataatgcccatgtgtcatggacagtaattgaattatgggggtggtttcccccatcatgctgttctcgtgatagtgagtgagtctcatgagatctgatgattttataagtgtctgcatttcccctgcttgcactcactcagtcctgctaccctgtgaagaagaggcctgctttttctttgccttccaccatgattataagtttcctgagacctccccagccatgcagaactgtgactcaattaaacctcttttctttataaattaacagtcttgggtatttcttcatggaagtgtgaaaattgactaatatagcatattagctcaaatattagtttatgttcaaaagttttgatgtcatgttgggagcaactggaacttgggcaagttaaccttttcgaacatcctttccctcattactttaggcaaatgctaacatggaaatattagcatttgcctaaggtaatgatttgaaagcttaaatttgagaacatgagtcatttctcattctttcactttcctcatagcacataacatgatttgaaattattgtactttagttttagtttgatagtgctgatctccactccttaccttcccatcaccaagagtagaggtcttgacggctgttttcatggttttatctatagcacttgatacagcattggacacctaggagatcctcagccaaagaaagattaagaaactcagggagcataacactacatctgaaacacttagatgatcagcattttaaaaaaatgtctatttaggttcttagaacaaggctatggcatcaaatatatgaattggcttttctaccaagttcttgccaactgatcagatgatgaggaaagcacatgtggccagtagtctaactctgagttctcccaaagttcactgtttcaatcaaggtcaaataaactttttctgccttgggccaggttgagtcatgatagctttaaggaaagaagcaagtaaataaaatgttctgtctgatctgcctggatgaaccacagtcttggcaccaggacctgaccccctggaagggtcagcagacaatggcacagaagagattgttaataataaattataaacatggctgcagctaccatggggagaccctatatcccctccccagcccacacattcactccctggcctgttctgccccatgggcttaatccacatcagagtgaaacaaatccaataaaacgtttccctgagctaagagggagttcaatgattcattctcattcattctctctcttcctgccaaacatctaatcctagatgacgaaagaacaaaggaagaggcatttcaaagaagtcatcctcatgtgtctccctgctgctttggtgtctcacaagaatcaagaccctgccctgaggcttaccaggacttagcagtaaatgtcatttggatatggtgccattagtgtcctctcaatgataggacacgaatgtggcaccttgtcatacctctttgctgcagtctcactcactggggactaccatactgctggcaaagaggatattatcagagatggtatgtggggacagacatagtctctggcataagttggcagcacaattgctgaagatctcaagtggtgacctgggaaatagtgtcttagtggaaggaacactcttgcagtgccatgatttacatgttgtaaaaatgtcaagggaatgattctacacagatggtagaaagggaaaaaatcttcccagtaggtggagattgaagcagttggcattaattcctagggctctcattgcaaaacgcctcagactaggtggcttaaacaacataaatttatttcctcacagttttggaggccagaagtccaagatcaaggtgtggtattgacaggtttattttttttctgagacatctcctcttggcttacagaccccccccttctgtgtcctcacatggtttttcctccatgtgcacattcctgttatctctctacacgtctaaatgtcttcttcttataaagacatcagtcattttggatttgagttcaccctaaatactctattgtaacttaattaccttgttaaagaccttatctccaaatatgacagcattctgaggaacttttggctgggacttcaacatatgaattttgtgggaacacaatttagcccataacatgattatccaatagtttactttgtgtggaaagagaagtatcccaaggtgagactatatcttgattctgaggctgtggtcgatggcttggccatgtggtcagcagcctagaaggaaaaagactggaagattggggcaagaaagtcagaggtagaagtacatggatagacatgtgggaatagcaggaaagggaataacatttgtttcattcctcatctcactagaaaatgttactgtgaaagaggcactgaacaaccaagtagacagaatgactcagtgacattaggtagctttcatcgtgagccaccccaggactgatacaatgagcacatgggcagagtggccatagtgcagagatggaggctactatgggcccaatggcatgggctttcactttttccagccaattcaaatgctgctgtccctggatagttagcatgttcgcaatagtaatcaacaataagcacctaatatggcactatttcttggagagtccaaccagtcatttggtagcaagtccacctcaagtggcttcttgcaccttggaaaggtcagccaatagtccttgtggggacagacacctactctgaatatgagtttgcctttcctgcctgcagagcttgagccagcaccactctgcaggggcagagtatgtaatggctgatccaaaggcatggaattccatgcaacacggcatccacacagcattatgaagagaccaacttctcatggtgaagagggtgttggaatggattcttgttcttgtaatctatgaatttaagtggaattctcctagaattgttcagcagtatgagatccttgtgacctaagcctcccttcttcctacaatctttcataggtatcagaccagcattacagtctgaaagctctttccaccttccctaacccactctcctttactactgataaagctgttgcatttctagtcctatattggtacttgcttctctgaagactggagcaaatacaaattccttctcaaggaaacgattctccttccctcttgcctataatattggtcagctttcatgggtgaattcattctatgtccttctaccaccccatataatcctactaacaagttctaatttaactatgactgtgtgaaatgtattaggagagttttttcaccttttctttagaaaacaataaaataaaatgaaatattggctcaaatcacttaatcacttaataaaatcacagaactcttccgttaatgcattatgcataattatatttgaactttctgccttaggaggaaattaaaatttgtactaatggaaacattcaaattatttttaaaacttacctttgcaatagtggtagttagagatttagccattaatcttccatggcattgtatttgaaggattttgtcatgttatgcgacttgaatttcagtgacgtctaatctgattttaccatctaggaaaaccagaatatgaaaatttttattaatttaacattttatgttttaaatatatttcacttttaggacaatatatacccagaagtatcaaacatcaatctatggattcataaaacttgtgtataattgctttatttactatacttacaaattttcaattaatttaaatttagccaacctccatattttgagggtttccaaaataaagtattttgcccaagtcatcatagcaaacaattgacttattttttctaatttaaaaataactcctgattttccttaaattactttgtaaatatttccaatactacagacaataacaaatcaaagaaataaacaaataataaaattaagcatttatttaaaaaaaatccttgaaagcatgcattctctaatgtttacatttttaaagcaacttttgaagcttccagagaattgtgaggttcttggggacagaggctgggtcattcctcttgtgtttctgtgatccctagaaaggcagtaggcaggtagttagttttcaataactgtttcctgtttctgtcagatgctccccatccctctttgagaaaaatcttgctctaaggagcaaggacaatagagatggacctgtgtttcctgtatgggtcttgcacaaagagggaatgagaagaattttaaagtacttgctgaaaaaggctccaagcttttgatttttcaaaatttttactgctccggagctaaagcacaatattcagaaaatcataatgcctgcttcactatatttgcctgtgaagtccccatttgatcaaaataatgctagacagtttctctcttgatctgtttagaatcaagataaggtcaggtgttaattaatgttgaattaccaaaaattcccatggaaatgcatatgacatctacattataaccataattagctaattaaccaatcaattataatgattaatgtgatcataatgaatgtatggcaaatggttattaattcttagagtttccaaagtaaatgcattaatcacagttgaacctgtggtaaaatgtgggtgcctaattatctttctgaactctgggtgtgatataataattttcatctgcttagaacttttgccacacattgtcttattattttcctcacaacaaacttgtgaagcagttgaaggaaagttgtacttttattgttgttgtttccatttcacaggtggttaaactaaattttagaggggcaggtgattttcccaatatctcatatcttcatatttcttccttcaaatagatcttccaatgatcttagttgatacttggagttctaagcttgaacatttagacaaggctttccccataccttcccagatgttctgctacataatactatgtggtgtttacttagaaaactagtcaacttgtcatcatattacagatataagggagaagagtatttcaccttaccactgagggagagaaattgtgagtcatctacaaaagaaaagggactttgggagctggggttctggtgcaactactgtgtcgttgtatgtgagaggtggagggcatgtgtgtaaagaaccattgcataattttttgggaattttcctctagtacaaatctcatagcactgagcacagttccaagtacacagcagcaatgaacaaatgtgcttgctgaattaaagatacttaactggaagaggagctgaaaacaaaaccaactaaccaaccaaaacaaaacactgaagggtctttggaatcagataccaagccttagaatgaaaagaagacccttagagctttacattcatttattctctgattttccctggggaaattgtgtgactttggaatacgtgatcactatatatatatatggagcaagtcaacaaaggaatgctgtaggagataaacctggagcttgctccagcgtaaggcttggaatgggatgaggaagatggaggacattctaggtcagagcaaacacatctatccagggcagaagtgggagcaaaaacactaaggagaaaggccttgcagaggtcaggatagtgccaggaagaagaggagacatgaaggggcaggtgaccatttgagggagagtccatcatggaagaacttgaataccaaagaaggagtggaggcagcacatggtagaagaaaatcctagaatagcttcagctaggggtcacttttaatagcactatacaggaaatgctttcacattaaaaggttttggggtagtggatgaactttttgaggtcttgctctacttcaaagccaattactcttaaacacttcagaggcattttgaaactgactctgaacctggcacatatgttaatgaggattttggtaagtgacatcagcagtttcattccagtgagaggggctacccagaggatgatcagcaagtcaggatgatgcccatgttcacctgtgccctgcctgactagggagggcagctcttgccaactgaagggctggaggttaatatcagaatgtttataggtatacttacatgagcccacagttaaattctatgttgctttggaggaaattctattctgtggtttattcatttttaactaattatcaagttgtagtcataaacactaaagttaatattttctaaaatattatgtatattaatttactgtacagttcattcctcacatatttattcagtgatgttatcgtctgaatgcttgtgcctctccaaaatgtgtatgttcaaacctaacccagaaggtgatagtattaagaggtggtgcttttgaggagtaattaggtcttgagggctccattctcatgagtgaaattagtgcccttagaaaagggcttgaggttacatgttagccctttctaccatgtgaggagacagcaacaaggtgacatcttttgaagcagaggtcaagctttcatcagacactaaatctgctggctccttgattttggacttcctagcctgtagaactataagagataaatttctattgtttatgaattagctagtctaaggtattttcttagagcaggaggaagggactaagatgggtacttactaatctataatggaccccaggaagacaaagataagtacaatgtatttttccctctaggaactcttagtttagcaggacaggaggacatgcctgtggataagtgccttttgaaactggttccacctgacaactgcagtcctggctaaagtgagcagagtgtgtggaacagaagccatgccccttatggaccaggcttaactaggctgattcaaatctatgtgctttagattatgtaggtgagcatgctgggagaattttaccaacagttcttcctatttttgatgctatccagaaagttctgtcactatttggaaaatagaattttgtgtagtagttaagaatataaacactgaagtcaaaagaatctatgcttatgttgtgtataaaatgcacagaaaagtgcctggatcttggaatcttagtctggatatctccaatacagaacatgagacaaggttccaatgctaatgttttatgggaaggtgtaaatccaaggcagtgagagtgaaggaaaaataaagtggggctgggaaagatgaaagcaaatacctacgtgattattgtaccaggctttcatgaagagttggaaccatacattcagccatgcaggagatctgtttagaagcaactatgcttcagaataatcccaaacacccatgcttcagagaaatgcatgcagagggacttgttctgccagatcccttccttctcttgtcatctgtcaatgaaagtgctcagcttggtctaagaaatgtcaagttttgaggtggtgttgtgggagcaatagtactgctgagagagttgctggactggactggtcctagaaacatctgctatagcatcagtgtgctgcctggctccagcttggagtatcttgttttcgctgatgcctggttttgattaaaggcacatgttgtgttcaaaggcccctgctcagctcagcctctgtgtgcccttatgtaattagtttgtttaaactgtgtctctgattatgtcaggtcttgactgtggccctaagtacaagagtgtaataagatatacctattaaacagatgttggactttaatggatatgttttgaacagtcaattggaattaaactttcaataactactgtagaacaagaaaatctatctctttacattaaacaaagcaatgtggcctcttactggttctctgaagcagtgattttcccagatgggctgtggccagaatcaatgagagaaacttttacaattcagatttttgggtcctcaattgccaagtattttgatttgtggctctagggtgaaatgtaggcagctgaatttttaaatcgtcctaagcatagagacaatcagagacggtaatttatagacagacgtagtcatttttcaaaaatcaatttttgttactatagatcaagtatttcattcacccatttattctacatcaattgatcaattcattcccttatttctgcatttattccccattagtttaatattccctgattacctggtaagcataagttgctggactagactccatccagatacaaaagatgtctacctaagtaagacatgcttctgctctagaaagtgtttatcatttagctaagagtggagagtccaaatatctattcagcacctggtctgtttcacgcatgagctacttgcttttccatttgatatcttatgatagccctagggaggagatcgtattatctccattttacagatgaggatactgagttcagatagtttaagtaaactgcccactcttactctgtttgtaaatgctagagatgaggagataaaatgtgtgtaaagaaaataagcacatcaaaagggagaaatcaattatcttatgagtcagtccagataaggggtacagagggttagtaaaagaagaagttactttcagcccaaccgggtaaagacaactgcctaagcttagaagaacaaagtgaaggacatttcaggcaaagtgggcatttgagccaggagttcccaaacttgacaggtgatttgaatcacctgggagctttaagatgattctgatttagtgactctcaggtggggccccagaatctgtattatttataagcacctgaggtgattctgaattatcagccagagttaggaataagctacttgttaacagaatgaatagaggcagaatagtattttttaagtcacatactaacattgcaacttaactctggctggaattgagtcattcaggaggaatgtgttgccctcaccttctccattagactcatcaacaagtcctgcctgtcctgtacacagcctactgctctaattctgctctcctttctccagctccattgctactatgtggtgccactcatcctgcttttgaattcactacctctaatctctgtcccttcagtagacacagcctccactcacagcagctttaactgtccttctaaaattcaactgattatactacataatggctgttacccacttaaaaaccttccacactcttcattgttaaattcttcagagtgggctttaggcttttctcaaccacatcaactccttcattcatttgttcattaatttataaaatgtacttagtgtctatgatgtgaaaacaccgtgctagacattggaaatacatgaaaagaagacacaattccttttgttaataagtttataaagtacagtaaatactgttaaggggtaaactcaaggggatgagcaacacataagaggagctgatgaccttacctgtaagagttggggaaggttttctggaggatatgatgcctgaaagacaggtaagagaaattcactgggtaaaaaaagaaaggcctttgtgaataggggcacagtaagaggaaatgtggtttgttcagacaactgtcaattgccctgcaggaatagcaggtgtggaaagagtaagtattgagaaataagcataaatgtaaacacaattctgggattgatttgggtagagtgggtgcaatgttgacatccaaatctaactgggtagattgaagtaaatgatcaaattttgtattttaaatgcaaaggctcaatatattgaactaaaactcagttatgctccaggagcggggaagggtgtggcttaacatcagcagtgcatgtgtaaaatgttcagagtggaactaatgtcagtggtatgaagtggcccctgtatggacccagtcttggaacaaaatgtccagaagtcctaggacactggtatccttgtgttcagggttagtatccacagtacaagtggcacagagaaactgaaatctccaaaggcaggttactggagaagaaaagaaatgctaagccataacacacatgagaaaatcttggaggaatcaggatggctccttctggagatctttaccagctaattatccagagtgcttccttgtggaagagaaattgacctttggaactctagggtgcagagctgagcccaaggggcaatagtcatgcataggcaaatttctggtaagtacaaggaaggactttgttaggatgacatttgttttcccaaggtgtattaaaggagaaccatacatctaagaacagataatatgctagtgcctttcttatctctactaggtttgattctctgatcaaagacagaatttttagtaaagaaagggttgtctgatttccagtggtcaggagagttaggaggatgttttagcacatgcaaactttttttctgtaaagtgctagataaaaaacaaatgaatgtggctgggatctaataaaacttagtttacaaaaacaggcagagggcagagtctggcttatggactgtacttggtcaactcctgttttggcagatggtgaggaccccaccactgagattattcaagtagaattgggggtttgcactaaaatgatcttcttaagagatgataactataaatgcaggcaatctctgcagaggacatagactagtggggccttcagaataacttagcttaattctccctctataaaaaatgaaactgaagctctacctcccccaaaaaaggatttgcccccaaatgtagaattaggtagtggtgtttgctatcctgaaagagatctctgttgctcattttacttatatctgtatattcaagagataaaaacaaacaacaacaacaacaaaacacttgttttttggtttgtaacaaggcttccaactttcctgcctttgattaaaggattttctagctggtgcctgagctttcctctgaggtgtgtgagcctgctcctctctgtagattaacatgtgcattatgaattcactgtcaatgtcagcaggctagcttttccagttttacaaacgtcttttctttcaggagctggaaacgttctcaaaactgtcctgaaagcaagtaatgctttcagtcgttgtcaccttcgtgaggaacatgctgcaacttcgctttctgacttcattctccgggtgacatttttcacgcaggctctgacagagacagcaattataaagacatccaggttggcattcaaggattcttgaagttaacaaattgtccagggataaatgacaatgaagttggcagtctacacatttcttcatgaaaatgcatgctctgggggatcagaataagcctcagaaggagatgacacccatgctcatggtggggcctgtcggagtgacccccagggcttgcatcttcaggaagctatttggcttaggtcagctggactgtaaacttctgggcagctatcaaggatcagaggaaaacaatgaaaatatgtacttaaatacaacgtagctttttgatttgctgacaatatctaagtgcaagaatggtgtttattcaaatctaattccctcttgtgtatattcaccattcattggctctcatagcccaaagtctgtcctctctgtgcagcccagccttcccaacgttccagtgttttggtctcatcccatctctcctccattcaagcatccacttttccaactgttgagaacacttcacacagtctgttccctttacttggaattgcctcacaatttcccactaagcattcagctcaaaaggcaccttttctgtgaagccttcttttcttattctcatgagaaccatctccattcatgaacagagatagaaggtgggggatatcaccagtaatgtcccagaaatcgaggaagctttaccttagaggataacagttgtatataattgagacccacaccagtttctagaaacaattccttatggtattgctgagttcatcatgaagcaggaagcccaaaagtgcaccaccaagtcttgatgggcaaaatcagtaacttcatgctaccgagtgctttgtgtgtgtgtgtgtgtggtgggggtggcaggggcgggggggactgattttaaccttgcatacatactcactttctttctttctttctttctttctttctttctttctttctttctttctttctttctttctttctttctctctctctctctttctttctatctttctttctatctttctctctctctctctttctttctatctttctttttctttctttcttttgttttctttttttgatacggagtctcgctctgtggccgggctacagtgcagtggcgcaatcttggctctctgtaatctccatctcttgggttcaagtgattctaccgcctcagcctcccaaatacctgggactacaggtgcctgccaccatgcccggctaatttttgtatttttagtagagacacggtttcaccatattggccaggatggtctcgatctcttgacctcgtgatccacccatctcggcctcccaaagtgctgggattacaggcgtgagccaccgtgcccggcccactactcacctatttcttacaacttagaatctatgatctatgatagaatctatgagatgtgctattaggcaaactccattttaccaatgaataaatggagaaatagtcttagagctgttccaaggcttacaactagtaagggtaataaacgagccaaaagaagagctcgggcagccaatgtgaagagaagttggattggatcagggtctcaaagcggaaagactgaagggatccctaagcctctgagctcatcgccacagtgcactctccctggaaatgtaaagatgtgctgaggatatgactgtgggtagccttccccagaccttctttccagggtggtggctgaagctggttggagctttttctagaaatgtcctgactcaatctctcagtcacactcctgagcacagaaaggcttgcgctgtgcctccctccagggcacctggtcctggatgtgacttggaaagaggaggacatttctgtagaccaggcagagcagagaactaggaggtggtgggaggggtaggagggtgagtgaagcggtgggcaataaagggggtggggagtgggtggggggggtccatggagcaaggatagctgcagcttagagattgtgagaatgattatcttttctccattaaggataatgacagtgagaggaggcagccaaatgcctaagcagataggggtgggtccccagtgaaaccccgccttcaagccaaaaaaacagcctgaaggctgaaagactggactgctagtcctggatgaaacctgcaacccagagcaaggacttctgttcctgtttacctgcccttctccaaatgattatgaatgatgccttttaactaatggaatgttgccttttccaatactacctatggcctgtctcacccctattctgagcccataaaaagccccagacccagctacacagaaaggagagaaccacctgactttggaggtgggcaaccactccccacccctgccccacatcccctctcctttgagagccattctgtcactcaataaaattcttcacctcccttctcatccttcaatgtccagcatatcctcattcttcatgggtgcgatacaagagctcaggaatcaccaagtgcaggtacaagctaaatacaggcaagctggggcatgccagtgtgaccaagcgaggcccaggtggggcattaccagctgggggtccctggcttgcaaagtgaccgagaagaaaattcctacagcaataacaatgacagaatttgtgagatgcttactggatttcagactctgcattttgctaggcttattgggtttattcttcatcaccattctcattctgcagatgacaggggtaaaactgagagccatggagctcaaggctgcacagctaaaggagatagggccaggattcaaacccagctccctcagcctgcagagagactcgtcctgtgctgttcagccacccagaccaggccaagggaagatgtttttccctttcagcatctttcctggtaatcagcactcatgagacctacagctgtcacaaggtatcatgaagttctattgggtgtaagaaagagttgactacatgctaactctgtcttggtaagagagctagactagccatgctactggtgagtgatacagcagtatatgttctcatcaaatatccagttcctgatacagggcctggcatcaaagagacacacgataaatgattcttgaacacattttgaaggaagtcatagcgaatgcactcagggggaccagctctgacctttctgccagtgcttccccaggctcagataacacatatttcaaattttggagaattctgataccagattccaaagggcatccatctcagattccaaagggcatccatctcctcctctggttcaaatgacactctgcctaggtctgtgaccaggtcatctcagcatctcatccacctccttccctgctccggcctggagtcctgcctgctccacccacccaccctgttaatttctagctctgaactagctcagccacttctctctctgctcctattcctggttctgtaagttctcctgaaaaacaatcacacatgtgtgctgatggttgtccttatgaatgcgtattccatctcatcaaactcctggactttgagattatttgacttgttttctttcggttatttcccgtcaaccaccacagtcagagtgtgagggtgacttgggatggggagaggagggacgtgatggaagaggtgggaaaaggttttgtatggggttgtaggtgatgttttaatgttttgcattgatgaataaaaatagttgttaccataacccccaaaacgaatggacccataactcttattttacacaatatttttcctactgtggacagattcatcatgtttgtgacacttaaaagctgttttactctggctgctaggtgggatagtgtatccccacatctctctcaaagctcacctgtgtgttctaaaacttcatctccatggcacattttgcatcctcttatctcaaggttgttgaagcagatttaagagctaccttccttcctctcagcacatggacttgcaactttatctagcggggattctcgagcttaggtgtattaacactcagatggctgagccctgccccacagagtttctgattcactaggtttggcgtggaacaagaatttgcatttctaataaattcccaggtgatgccaatgttgctggtctggggaccccattgtgagaatgactctatgacacctatccttgccttcttaacttctgtctcagataaacagttgtcctctcttcttttggcagctaacctctccagttagggacactaaccatgtctcctcaaagcatatgtagaaaattcactatggtcagggattgaactcaatctcatgcgttcagcagtaagcaaagctgactcagacactttagataagaagagaggtatcatttggatgcagatacatatgatcaattctgaattggttgaaagtgttgcttttaccaaactgatgacagtgattatctacatgatgatgaaatttatggatagatgctgaaacagttatatatatatataaaaaaaaaacaattccccaaagattgggaccactacgaagaatttgccttctttaaactaggtaccccagtagagaatgttattttccttttgcaaactgatctgcagtggtttgtggatgtcagcttgctatatgcctaatagagttgtctattcctcaattccacatcttttgcagaatatttcagtgagattcaacctcaaaaataagagtaagaaaaaaatacaggaaggttggctgagcagtgcagcacctacctatggcaactcttaaatcatttgatatttttgaagcttttgctccagtagaaaactcagacctctgagttggatggaggtgaggggagtacaaaaccaacaccaggggttccttgcagcagcccagaaagcacttgtgaatgtggcaggaaatgagatcttaagtcagtgcataaaacaatcaaatccatcacagccttggaatggcccttataactcagggactgtcaaagccctttgtgtgcacagaggcagtcgtagaaggagtgacgaactgagctcagagtctgctaaatctattctggcagccagaggaatatatttccaaagccaagtcacatcattttccttgagctcatttgactgcaggctaagaagctattgcagaaaacaaaagtatggtggaaggggtgctggaataatgaatattaatgaacttaattctctggtttggggttggcttgtactggtaagatgcaaaggcggataaagaagaacgaattgaaactggtgcttcaaaatgaacagtcttggccactcatctactgatctaatacatgtttacagtgtgcctactatttgcttgctcctgggcttggcaaagatgaaaaacaccaaccctctgtcctcagggacttcctggcctgttggagacacagatgtacatggtatcatgacaattcagggctttgctgtccattatagagaacacatacaaactggaggggaagtcagagaaggcacagcagaaggtgcaaatgcttaaacaaagcttccctctggcaggcatattgactgaccctccttgagttatgagcttgagctttggttaaagctggcactgcaaagaaacagtagctagatctcccggtttcccaggagagtcttgattatacacgtttttcctgttgccccagttgaattgtgtcttcccaaaataaacgtctgaatcttaaacccccatagttgggaatgtgatcttatttggaaatagggtcttcgcagatgtaatcaagttaagatgtggtcgtattgcattagggtggccctaaatccagtggctgatatccttataacaccaggtgaaaacacaaagatagaggcccaatcatagaggggagaaggtcatgtgaagatggaggcagaaactggagtggtgaagctacaagccaaggaatgccaaagactgcaggcaaccaccagaagctagaagaggcaaggaatcattcttccctaaagccttcagattcttccctattgacaccttgatttcagacctcttgtcatctgaactgtgagaaaataaatttctgctgttttaagccacctagcttgtagtacagcaagtcctcagataacgtcgttttgttcaatgttgttttgttaaaatgatgagaaaaacataaattcctagctggggccactttgcatgttctccccaaatctgtgtggcttttctccaggtactctggtttcctcccacttcccaacactgtgcctgttaggtgaattggcgttgtctatgtgatctcagtctgagtgagtgtatgtgcgcaagtgtaccctgcgatgtgatggtgcccttgccagggtaggtttctgccttgtgctgagagcttccaggacaggctctggccacctgtgaccttgaactaaattaagtgggttggaaaaggaatgaatacatgaacacagactattgtaaaataaaaatttgcggctgggcacggtggctcacgcctgtaatccaaacgctttgggaggccaaggcgggcagatcatctgaggtcaggagttcaagaccagcctgaccaacatgaagaaaccccatcttgtctaaaaatacaaaattagtcaggcacggtggcacatgcctgtaatcccagctatttgggaggcagaggcaggagaatcgcttgatcctgggaggaggaggttgcagtgagctgagatcatgccactgcacgccagcctgggcaacaagagcgaaattccatctaaaaaaaaatttttaacttgatgttgcagtttccaagaacctatcaacaatataatctgaagacttactgtacttttttacaacagccataggaagctattacaactctcaagtttgaattttgattcagaacatgtggtgtctgtattttagtgttccatatgatctagaataagtctgaggagataacttctagcacttttgcttccccttttctctccctgccaaactcttcctaaattcagttccggattaggaagatcacttctcactccacctggcagggtcatcttcttgactgcacctctccagtttctctctgagactggaaagacactccagagataaggcttgtcctaaccaatcagcactcagaaaacatctattgactggatttgatgtaaggtgggctctaagtaaagcctgaatttattaatcctccagaaagtttactgacctctctgagttggatgaggccagatctaataatgagtatgttccagactactaaagacaagcatatttatgactatattcacccaatttgggattgcactcttagactactgccatttacagattacattagcagatacttttggaaaacaatttggcattgtcattagtatttataaaatgtttgggttctttgactcaataattaaacttcagggaaactgtcctgaaaacaaaccaaaaattcagacaaagctgttgctacaatgatgtcaaaatgatacaagaactgaaagtaatctatatgtccaacaacagaagaataacttagtaaacaattatagtgtgttcataaaagagactattacacagctacttaaggcagtgctgttgaacgtcatgtgttaatactgaaatgctttaatatgctaagtaaaaggaagacgtttttaaaaattatatactatgatgacatcataaagtgtccgctgaaacttggctggaaggaaatatgccaaaatggtaattgtatttgtgtttgctcttatgaaatcccttgctatgtctgcgtttgaatttttctgcaatgttttcatttttgaatttttttttttgagacaggatctcactctgttgcccaggctggagtgcaaaggtgtgatcacagctcactgaagtctcaaccttctgggctcaagtgaccctcccacctcagcctccccagtaactgggactacaggtgcatgccaccacacatggctgattattattattattttttctgtagagatgggatctccctttgttactcaggctggtcttaaactcctgggctcaattgatcctcttggctccatctcccaaaacactgggatgacaggcatgagacatatttttgaaatttaaaatacaaaggaatagaccttcagattcatttatttatgtgcttaaaattgatagaaaatagcaagtcatttcagtctattcattaattaaatatcagttgctatttcatatctatgtgcaaaagaatcttgtctatttcacatgttccataggaaaattatcttcctttaaactatgacctctgagcaccaaattcagtctactgcctgtttggtaaataaaggtttattggaacacaaccacatccatttactttaggctgcattacaacagcaaagctgagtagatcttacagctctaaagcctaaaatatttaatctctggctctttacagaacatttgcctactcctgcattaaaacatttttccattctaacttcaaataactccaattggtcttttctgtcgttcctgataggaaagcctgtttgagcttttggcatgggcatctgacattagctgaatccatagaccctggccttgatatgtttaccctggcatttataatatggctcagtttggatttggtggaggacactatgcattggtgggaaattaggaatcttgttttgttttgttttgtttttgagataggtcttgctctgtcacccaggctggagtgaagtggcatgatcttggctcactgcaacctccaacttatgggctcaggtgatcctcctgcctcagcttcctgagtagccgggactacaggcatgcaccaccatgcctggctaaccttttgtatttctagtagagatgggttttcaccatgttggccaggctggtctcaaactcctgacttcaagtgatccacctgcctcagcctcccaaagtgctggggttataggcatgagccaccatgccagtctaggaatttggtttttaaagaatccttaaatcctggagtttggatctctggacacctccccctatcccaaccaaataggttctgggtaactaactcccactcccacgttaaatccactccacagcattaaaagaatggtccagagtattggtatttttgttattatccactccaaaagatacaattgaattcgattagcaatatagcaggaaggctactgctccagcgactgcttttgtcttaccccaaagcagctcaagttcattaaaatcacaattatctgactcttaattaggtgagataatttaattaacaatgcccacttaattgtcgatggcaggaaactgagacgagcaggctccatggtggctgaggcaacttagcttgaaatatagtggatggcattctgaaccagccggctcagtgagctctgtgcatgcacttggcatgtgaaagacctgagaaaagtaaacttggctctcattagaaaatctaattctgatctggaatggtgagggtgaaggatttatagcatgatggccaaaataatgatcctgaatcagctccctaaatccttgtcattcattcattcattcattcattcattcattcatacatacattcatttactcattttctatttctccacttttattccttctcttgtttcttccttctctctccaccttccaaaatctattaaaaccttatttttgttctattaagtataaagtgctttgttggataccaaaaatgggtaagaagactttttttaattttaatttttattttttatgggaagaggcccgggcagtctgaatttcaagaaaaggaatgatgatggtaactttgataaccacagtttattgagtccttatcatgcaccaggcaatatgctaaatgctttaatctcattatcttattttatgttcacaaacccctgtaagctaggtattatcatttgcattttaccaatgaggagaaactggggcttcaggtgataaaggaacatgtttagggtcatgtagccaataaaggacagaacctagatgcagcacagatacctataatgccgttgctttcaaacactagataatggttcccttgcgcagctcttaaacccacagaacggtacacaccccacagcatccctctcaaaccttgggacctccagtccttacactgcttactttagtgcaggcatacctatgtgtccggcttttaaaactcataaccctgggctcatgggggccaggtcctttctttttaagcttcttttcttgctgtttcaaccttctgttgtgggatgttgctaaagaaaaaaagtgttcatgacacttgttaaagatggcaaggaagactattcaaggtcagggactaggatgggaagtatagggaccattgcaatggggtcttacagtgggggagacagactggtctcaactctgactccagcaagcgtaagtggagatttatagccaaggagcaaggtgaggggtcaggagatggaaaattactaagagacatcagggatagggggattctggctagactgacttgataaaattcttgcttaaggcaggccagagtgggggataaggaatttgattagattaccaaggatgagagattttcactaaactgaccaagcaagagtctgctaaaactggactaactggccagagtcactagggcaagatcagagccaaagaccagggcctagtaagaaagagaactcagagaaacctgactcaagtcttgtcaagggagagaatgacagagtccagaagggcggagctcagggctcaaagcaatgcacttctgatcctcagtggtggtgccattcaatgacttcggcttcaggtcctgtgttttactccttttgccttgcaccttcgattatacactctttcgtggacatacaaggactttgaaattgttcaaagtctggtaaaaaatttccataaagtacttccatagcttttagcagattctctaaggggtccctatgagatttaaaaaaaaaaatctagactcctcataagtgtctctcagagctgtgacctacacactcatggtgacttgttaaaaatgcaaattcctaggccccagtctggaactggctcagggattggcaattcctaaaacgcccagaaacctgcatttttaaacaactatctcttattaagaaatgcctgatcttcaaggtggcagcaccaagctgtgatgacatttgaagtcctggattgaaatcttcctattattttgctaggacctgggcttggaatgcatccagcatcctgctgaggcctgggggagctgaaggggtgggggaagccggctgtatgtttgcaggtgcaaacatggctgtatttctcacgtggccttttccctggggctttattttgtccagcaagccagcccagtttccattgttttcaacaactgtgattgctgccagtgtgtagggaaatgtgaactctaaagcttgattcaaacactgtgaccagcttttattccaaacagcagcccctagggctctgtttgcaaggcagccccgaggcctttgaggccagggtcacagtttcctctgtttgggggcagaaggagcacaagctgacctttccctggctctctacagccttgtaaatgttgaagtttgtgtagtttgctcgttctttacaatcccgcagagctccttgggtcagtttcagcacagggagcgctcgactattaagcatttttgaggaccctgggcaggaaatacccacgttggccctcttgcttgtagcaccaggttcaaagctggtcaggaggttatgtcccaggtgctgaccatgattatactgctttgggagatgatctccttgctttaggtcacagacaagttagtgacacaactagaccccacatttgacatctagcccagtggctcagttctcagccttctttgcttccaatggagaaccagtcacccatacagcagaaaatctgacacattctgtccctcagacctgtgggatatagaaaggctattttcctgttgaaccaacccctcccatgcccctttcctctcccaatccactggaccagaaaatggtacaaactctaaaaaacatcagacattacacttgggtcctagtttttgagggccaatgtcctgggactttctccccaagtttttcaaaaacaatcacataaaagcgaactattgataatttaatagatatttattccaggtagaactccacacaaggtaaactataatccctagagattacacacttccttcttcctcacctcaattcattaccaagtcctagtaatgttaattccatttacctcttgactccattgaccgctgtctatccacagtccccagcctggttaggtttccaactcctgagcttgaatgattgaaatagcctcctacttctgttcagtttcactcctacctccaaccccagatccattctctacaaagcaggtagggctatattttctaaaatacaaatttgattatgtcattcccagcttaaagcctgtcaagagctttagaaaatctaccataatgaggtccccttgtgatagggttcccaccaactttctaagcctgctttccttgtcttctatgtgctttctgttacatttctagaaaacgctgtgctatttctcttcctttccctgctcaacgtctagatcatccttcagagctcatcagaaaaccctccctctgagaacttttcctgacctcccaactggtcaggagtccctgttaaagccttatagcacttatcagcacttaccaccatctatatttatatattttcatgtgactctttaattagtgcctgcctcctctgtctcgactgtgagtcctcagagggcagagactctgtttagttacatcctcctttttccctgatgacagtcactgtaccaaactcagagatattcattctatttctaatgaatgagcctaatgaatgaggaaaagagtaacttcctacattaaagaagtttactgactgggttggaaacattgaaatcttcctctcttgtacttgctaagtgagccctaggatttgtatgacaaaaagccatatatagctcaaatctgctttggaggctttgtggggccactaggtcagcaagaacacctggcttgtgctctgaaacaattagcctgacttgggttgcattggattttgttaaaacatgtgccgattgctacgaaaactgtttgcatataatcaatcttcagctgcagagagatgtcgagtatgggagggcgtgtcacgctggctgtttataaactctgcacgactgaggactcttccccaacatcccagagtctgtagtccttgcctgccctttcccaaagcaggagtgcccttctggatgagcccattgcgtgaattattttccttttgcttcctcaaaatcaaatgagccaatgtatttggggccccagggtaagggaagaatgtgagacacattcctggtgtgtccaagaccaaattgaagggaggtccaataatgtaaggtcaagtagccataggagtctatgggctgcatgcttctgtacttctctatgcctcattcccctcatctgcaaaatgggatgagagtgattcctaccttgtcaggagataggaaggcctaataggaatagtccatatgaagcagtgggaacagtgcccagcacatagtaaatactcagccagaggtatctttggtaaaacttcatcaaagacactcaagctgactgctggtgaaggtggagagttccctgattccccttgtaggacctctgattcccctcataggatgtgcgacacgagtgtggctcacctgtttcatcaccccacagctcaaattcctagggggaacatgcagacgggcaagtgcagaggccggagtgagtgctttgggctcttgaccccacggtagtgtctatcggtgagtgcctgcaacaccagtgttacaaagctctttcagctttaccatctgcagacagctttgagtgttaatcagctcaatggaccctctgccttattgcaaaggaagagggccagtatgacagccttctgtatcccaagctcttgtccagtgtcctggaataatcagatcacatgtgggcttgaagaatgagtgcagggttttgagtggtggaggtggctctcagcgagactgatgggaagctggaaggtggaggggtgggggagataatcttcccctggagtttggctgttctcagctgaactcctctcaacattcaggtgccccttagctccttctctgctgtgccaccctgctgctgtccgctgctctctgccactctccgtggctcctcttgatgttcagctgcttgtgtgtgtgaccgataaggtctcaggtttatatggcagcaggatcagggggcatggcaggccaaaaggcaagtttttgggtgcaaaaacagaaatgcctgtcctcatttagggctgcgggttttcaggcttgagggtgaggcctttgctggggaaccaccctcttctacccagtatttccctgactcctatctggataactggttctcaggtctcctgttagtggctaccagccccagttggtaacacaatcactggggagctgtttaaaagtacaaactccatggcctcactgaatcaacattatcctagaaattctgaccgggacatgtgtattaaaaaagaaaggtccaaagtgaagtaactcaggaatggaaaacaaataccacatgacctcacttacaagtgggagctaagctgtgggtacaaaaggcacacccagaatgagcattggagattcagaatggggagggtaggagggaggcaagggatgaaaaactacctattgggcacaatggatactacttgagtgacaggtgcactaaaatctcagacttcaccaccagacaattcatctaagtagccaaaaatcacttataccccaaaatctattgaaataaaaaaaaagtcctcagttgagtttgaaccgtaaggaccatcaatgaccactgcacagtttctgagtgagatttggacaagtgtctcgctctctttgtacctcagctttctcctctttacttaatgttgtgtcggctctatgtctgtttcatagcaggtcaagagagaaactcttggtaacaccagtgcttaacttagagcacacttgctttacttaaatatatgtattgccatctgccaaacaaaatgacaacttttatctctgcttgttcactttgtgtctttgtctagatgcaaatatatacttgaaatatcattcgtgttgctaaatatccacttatttagctccttcttttataagcatgcttctgtgttcccattttagctagaaaattttaactgtagttgttgcataaaatttcagtgactatatatatatatatatatacactaatttaaattaactgtatctctatttttggatggctaggttgtttgtaagttttctcactactataattcattctggaatgtgtattttcaaacatatagtttttctatatttaggtattttactgagtacattcccagtattgttattactgaattaaatgtatgaactttttttttgtttgtcttggcaatcaattgccaagttattttctgaataagtgttgccaaaatatactctgccaaccactaattaatgacagtttcatagtctctgtgccagcattcaaaattagcattttattttatatttttactaactgaatatacgtgtggcatttcatagttgctttatttacattttaaagcgtactttatcaattatatatatacactccttgcatgctatgtcaaattcccatgtggtggtataactaccaactcgataatacatagattcatcaactctgttcatcagagtgactttatagggtttatgtcaggaattgcctcaggtaaggagaataccactgttgttctctctttagccagctgttttctgttacaggtcctgaaggctggggctggcaagatgctgatgcaaccagggaagtggggcaacagacctctctgccacccagcccagagcctggcttaggccccaggaaatttgcctcccacctctctcttcctaggcccaggtcccagcctcttttcctattcaacatctgcaccaaccctcaccttggtacagggagctttctacacgctcattttcctcattagttggttaacaattcattaaatcaacaaatatttattgggcacttaccatgtgcaggcaatgtgctggggcacaggctacaatagagagggaaaaagcaggtgataaaacagagcttgtctccctggatctcataacccatcaggagataaagacgtgtattaggttgccacacacaactgtgtcaatcactctgcctcaaccatctagggaccttcaccacgtgaacttctttctgcctctgggtgtttgtgcatactgccccctgtgcctggagtcctcccataactaactctgtctgctgtgcatggagtcctcccataactggctctgttcgctgtgcctggagtcctcccgtaattggctctgccacctgtgcccagagtcctcccataactgactctgtctgctgtgcctggagtcctcccataactggctctgtccgctgttcctggagtcctcccataactgactctgtctgctgtgcctggagtcctcccataactgactctgtctgctgtgcctggagtcctcccatggctagctctgtcctttgcacttggagtcctcccataactggctctgccccctgtgcctggagtcctccatggctggctctgtcccctgcgcctgcagtcctcccataactggctctgtctgctgtgcttggagtcctcccgtaactggctctgaccctgcccctggagtcctctgtggctggctctcctccctcttcctggagtcctcccatggctggctctgccccctgaacctggagtcctcccatggctggctctgccccctgtgtctggagtcctctgtggctggctctgccccctgtgtctggagtctctgtgtctggctctgcctgctgtgcctggagtcctcccatggctggctctgccccctgaacctggagtcctcccatggctggttctgccccctgtgtctggagtcctctgtggctggctctgccccctgtgcctggagttctctgtggctggctctgccccctgtgcctggagtccttccttggctgcctctctcactccttccaactctgctcaaacatcaattttttaggggatacatctctgagaatggtgcacacaatactactgggctcttcttcccaccagtgctacctttcccagcctcattttcctccgtagcacttctcaccatccaatatactaatgaagacttgtgtttgcttattggctcttcccttcactgaatgtaagatccatgagggcaggagctctgtgtgtttttttttttcattgctatgaacagtgcctggcatagaggaacctcctaataaatgtctcctaataaataaaactgaacacgtgaatgaatgggttttattctgattcccacataggtagggggcccctggagaatttgtatggacatttgttggctgcagtgggtgcaatgggaagatgagtggtggacagggactaggggtgggaggatcagtcttttctagggccctgggcacactcctagtccttgcaataggactggcaagagcatctcagaactaaggctttgggtcctcctggagggaaaccctgggctcctctggcagtggttctgccccttcaccagacaggcagggactgccattgatttctggagatgctgaaagattcctcctgcagccagaagcagagtcagccaggaaggctgcgatttccagtctgtacaattaacattattatggaggtgtaatctctctaattggtttatttcatcaagatttgattgaaggcttctcttatctgccactgcagcctccctctacctaaggctcacgaataataggaagcaaaatgtatgcctgactcggcctcctcctaaagagaccagcccgtaaataaaacatctgggtctcctggggaggcgacggcatgaagggctgtgagcgggaacccactgattgatggagacaggagagtgttttcttaagtgaggcagggagtgatttctcctctggacctgggccccagagctgggtttctctgcaagagcagccagcctggaaatggcgctggcaatggaggaaggagggtggcagggggatggctgaagccccggcacactggcttggccttttgtttttttctttttcctaaccagacttctctgagaagaaggaagaataacttatgcctccacaggtctttccctgacaggtgctaacaggtcttcatgttgtcatgtaattaaccaacaagtcaatgatttttcagcaacacccagagagaatgagtttatgcccagttctgtccctaacttgaccaggctttagctccttgtctatgtaatgaagattgaacataatatcagagggcacttgctctctccagcagcaaatattgttgatcgatcatagctgcagacccaaaagggagcctttccatgcccagagagccatctttagtagacgaagattggtacaggagaattggaacctcttcctcctccctggaacccccaagaaaactctctccctcttagacgtaagagaatgattttgaaacctcagtctgattccaacacagtcaccacagctgagagttttgaaggaagtctttttcagaatagcattcccttcatgatatgcagaggtggtttgagttttaggaaatgcctaatgatagcacaggacagaattctaaaggcaccagcaagcagcaagcctatcagaaatagttgaagccaggcatggtggtaggtgcctgcagtcccagctactcagaagactgaggtgagaggattgcttgaggctaggagttcaagactacagtgcatttctgattgcatctgaaaatagccactgtaccccagcctgggcaacacagcaagaccctgtctcttaagataaaagcaaacaaacaaaaaacaaccaatgttgaggttacacattcccatcaacagcaaagcagataaatattactatttatttggttgtgttctatttacacaatgaaatactatacaacaatgagaacgcacagtctacaaccacatccatacatgagggatctgatgatgggaatagtgttaaaagaaagaaaacagacacagaagagagtatggtgtgtgattccctttatatgaaacgcaacaggtagaccagtccccggtattagacatcagcatgatgtttgccctgggcgaggcagtgactggaagggtatgtgaggaaggcttcggggaggtgataatgtttattgttgttggctgtgttggttttggggaaacattcagtttgggaagagtcattaagctgtgcacttgtgataagagtgctcccataaaaggttttataagatttgggggctggaaagatatatctgtcagtgagatttctcgccatcccagttccctgtccctgctttccttggcttgcgcccttgccctcttggcttgtcgcatctccctgtgaccttcccatgggcattcctcatggtgagaagtagtgtggcagagtggggaaagacttggaagaggtgccacaacacctggctttgatgccaggttttaccacatgtgaagctcgaggcaggcctcatgccatctgttaagctccagtttcctagcctggtcctgaaaagcgggcttagtctgtcctctctctatacgtgcttgggtgcccttcctctcacctcggtcctctaggtagctttattgcaccatagaatagagacgtggggactgtgagcttgtggcatcaggcagacctgtgcataacaaagccttgggcagtgattctagatttctctattctctaagggaggctgactattatataaagtcatagcaggcccagcgtcccttattcaaatctccaaacaaatgagacaattaacttggggaagtctcctaagccagagcttcccggacaaaacaagactatgattaacaagtgacaaggatagacatcttacaaacatgaagctggcattctcaaaactttgggggaaatgtgtgctcttgaaaaactcattggtaccttccatattataaatctgtttaaagtgtgcttgatagaatttgttttttttaaagaacagttgaaagtgaggggaaaaaaaaaagcttggtccctgaaacccaatgggttaattctcccctgtggcagaggaaatgccaagcagcctttggcagcgttcttccttctttgtataacaacactttcaagagctagagctgggatcatccagtaatgcttttaatttgtgtgtggttgcgaagaggccaggatttaatcgaaattgttagaatggctttgcttggagtagctgagtgcttgcagtagggctaggaggcaaggtagcgctggaataattaaaagaaatacctaaggcatcatcattgcctgagttattccagataccaggctgcagagtaaaaatagtgaaataaaatttgtgcacagttacttttctattatacctcaattttctctcttcccattcacctaataaaaggagctaggtctccatgtttgcttaacggggtggaggctaagccctgggaactggctgtttctcagccagcccaggtgctccaagttcctatttttatcctgctctgtactgtgggtggtctgaactggcttaccctcctgaattacatgtagtacacagctgtgctgagaacatttttcttgtcgtaccttccctaggtaatgggacagcaagagctccaaatcttaccctcctgagtgtcatccttaaacaacatgtgaaaaaaaaaatagtcacaggaattggggtttccatacttgtcctcatttctatcctctttctaaagagaacctgtgcccccaagtccccagacaacatatggtcaagattaggaatcatgtccccaaaagactaaataattcaagaaaaaactgagcacatctgtgaagcagagatattcacctgacttatttatatgttataaacacttaagtgtaccacaggggaccaagcatatgccaggcaagtcagtcactcaatcaacaagggttcatttacctctacaaaccattcagtttttcttttccccaatactgcaaggccctgtgctaagttctaaggtaaagaagagagaaagaggtgagccttctattctgaagccctgctaaaaagtgaggtatcacacgtggaaaggtttgaggtagatgtttattcaatgtgtttgggccaatagggcacttctttcgccgtgtggcaatgtgtttcagcacctctggcatcaagggtgaaggccttagcagttacccacagtgaaacaacctttgcaaaaattgtaacagtgagaaaattatgaccgtgaaagagacccgatccaaccaatccccatcttgcttttaatctccaaactgcctttggtcattccagggcttgggccaggctaactttgggagaaatttgattcatagttttttatttatttatttattttgagatggagtctcactcttgttgccgaggctggagcgcaatggtgccatcttggctcactgcaacctccgcctcccaggttcaagcgattatcctgcctcagcctcccaagtagctgggattacaggcatgtgccaccatgcccggtggctaatttttgtacttttagtagagatggggtttctctacgttggtcaggctggggcctccaggagtcagggtggttctaggggacaccatgcacttgtgagtggacagaccaccagccggaaaacaaaacaaaacaaaacaaaacaaacaaaacaaaaaaactgaagaagcagtgaggatggacccccggtctccgagtgtgagtgcagcaggcctaagcagccatggggataagtgggcacagtgtgtcccctgaacagcccactgtcctggagggagcactgtcacagagtcattggtcttatttagcctggcccagaggatgaccaaatgtgcagcactctggctggaacctggtgtcacaattctttcatctgttcccactccctacctcttgccctcgccatttctctctcttacctcagaaaagctggaaaccagcccttctgcttccagaacgatcttttagtatctgttctgctgtgctatgaattacattctcagtgcctagtccccatttctcccaggtacttctggcaaactcatttcctaaatgccattttcgttttggtcattccctttgcaaaatctcccgtggctccttcatgcttacaggtggagagatgaactcccttgcctggtattcaaggatctctaccatctggctctacctggttaacctcatcaaattctggaaagacacatctatccgacctcagtgatctggattccttggcatctctaggcactgcatgctcattttctcttttcaacttttgtttatattgcctcattatcttgaattcctctttgctcttattttctatccatatcccatacatgtgccaaattccaggacggatttctgtaataggagagaatagaagaaaggtgtattcataaattgtcctagggcaaatcttgaattaatttagatagagagattattaaataaaatcaagtaataatataatattaaaatacaactaaactatttcatcacatcgtacatctaaataaattccaggtatattaaaatattatattttacaataaaaacacaaaagttgcaaataaaatatagataaaacttttttatatcttattttatttagagacagggtcttgctctgtcacccacgctgtggcatgatcatagctcgctgcagcctccaactcctaggctcaaacaatcccccacctcaggtgtgtaccaccaggcctggctatttttgttagttagtttttgtagagacagtctcactgtgttgcccaggctggcttttaactcctggcctcaagcaatcctcccactttggcctcccaaagtgctgggattacagatgtgtgggtcaccatccccagcccataaatgttttggaagtccctaaaaagaaatagaatttctaaaacccagcactttgggaggctgaggtggatgcatcacctgcagtcaggagttcgagaccagcctagccaacatggtgaaaccccgtctctactaaaaatataaaaattagctgggcatggtggcacgtgcctgtaatcccagctactcgggaggctgaggcaggagaattgcttgaacctaggaggcagaggttgcagtgagctgagatcgcgacattgcactccagcctgggcgacaagagcgaaactccgtctcaaaaaacaacaaaaagaatttctgaaagaaagaaagaaagagaaagaaaaagattagcagagtgacaatagataagcaaagtcaagtggaaaactgcaaattgggtaactgttcacactaaacaaggcaagtatctcatcttttgtagatacccataagaaaacattaaagtgtaattaaaaactgaacagagaacattaacaaacattctactgcagataaaatataattagacaaaggaaaataatgcaagttaaagcagtagattcttttttatacataccagattggcaaagtaaaataataatagtgataacaacaataatttatggcaaaagtgcactgacgtggataaagcacatattatcggtgagtaaaacatctgagaaatcaactcgacatttttcaagaacctgaaaaatgattacacaattttatgataagtccatctatggataggtattctaaactatgtttatactagtgaatatttgaaaacagactaactctctcacaaaaggagaatgattaaataaatatatgtaagaggcaaaatttgattcagttattagcatactagtctctaggaatttttgatagcaggaaaattagtccagatttaatataagacaaaaaatggaatagaaacatctatgtaaaaacaaacaaaaagaaatgtctacatagctcattatctcaaatacgcaaaaatagacatgcacacatgtgcatgcacacacacactcaaataatatatactaaaaggaaatccaccaaaatgaattattagctattctgtgtgtagaatcatgagctattttcattttattatttataattttttttgcaaattttacatcagaaatctctattactttagaatcagaggtaaatgaaatgaatactttaaaatttccaattaatttcagccacaaagatgtcagcattctttaaagtcctgtatcgcatacatcctctgtacatcttccatctatgcaagtgtttattctgccagttcttcaatatccactagtctttcttctccatactaaacagtagtttattgtaagtattggaaggaagagatcatgtcaggggtccagttcactaatctttccaaggccccattcccttcagggaatattgatggagaactgatagggctgtttaacaattaagtgacacaattaatataaagtactgttgacaatgcctggcacatagcaagcactcaggtgaagaccaaggcgttagggtcaggttgacatgggttcaagcctggactctgagatttattagtgacaagattttgaaaaagctccttggcctcgctgagccacacttttattgttaagtgagaatcacagcagctattgttagcaagctgctgtgatgtggcatgtcaggtgcttttagcctagtgattggctgcaggaagcacttgatgaacagctgctgcggtgattcctcccaggagcagtggtgatagtagcagtacttccagtagtgatttttcttcccctgctttccttgtcactccattttagtggtaaactttttgagtgctgaggttctttgttagatctcatgctctgtccctttctcagacgggcattcagtctggcatctttcatttaggggatgaaacatgacaaattatttctcagtagccgagacgaaccagctttttgttggtaattcaggggcttctgagggaacagctagtgggtgtgtggtttccatgagtcctctgaattcgatgagagtggccaatgtgtggcagcaatgagtcaagacacctgtgcacctagcgtagagaacaggtattttgctggatttgattgaagatattcttccatggcaccttatgtttatattttctatatcgattattaatgaaagataaagatctgttgacttgtctgcattccatgatagactgtaagcttcaggagggaaaggatcatgtttctttttttactcatccaacaaatgttttggttgaacatttctctctctctctctctctctctccccacctgtctgtctctatctctgtctctctatctctcactccatctctatgtatgtatgtatgtatgtatctatctatctatctatctacgtctatttctctctctctacctacctatctctatctatgccagacactttgcaagttgttgaatattcagtggtgtacaaaataatcatgactttgcattcacaaactctagtggagaagagggctatttcataaataaatacacaaataagaatataattacaactggtgatgattcttttttatgaaggacaagaacatgagctccatgagagagaatagaattgtggtggtgagagattgacctaatttagacagagggggtcagggaaggcctgttggaagatgtggtacttgagattgaggatgagtagttctgtctagaagggagtggcttattcagtgctgcatctttggttactaccaatagcactattcaagaggatacaaccctaggtcccttaagaaaaaaaatttttttaagtgactctttgggtagaaagtcagagaatgagctggggaaaaagcacactggcccaagaaagagaaaacttggcaagtctgcctgaagactgaaggagacatgggaagaagaaagaagtgtttaagacatagactgagtccctgggaagcactacaagtcaggaactgctcatggtggcttgtttttgaaaacagaccccacacaaagctctgctgattgatggtttgtttcagaatggtgacacatccagaaaacaacacagacacaatatttcaaagtagaaaagaaaaatatgtctgatatccagaaataattaccaaccaattgaaatctattctacagttgcccccaaatgccaatggaaacaacattacatgactcacaaattcttttctgtccgctgtcttagccagcttgggctgccataacaaaatactatagactgagtggcttatacaacagaaattaattttctcacaattctggaggctagaagtccaagatcaaggttcttgctgattcatttcctgctgaggcctctcttcctggctttcagacagctaccttcttgctatgttctcatatgattttcccttggtttgtatgcaaggaaagggagggagagagtgagaaagtgagttctctggagtctcttcttataaggacactaatcttatggaattagggcctctctcttatgactccatttaaccttaattacttcattagtgggtctgtctttacatacaaccatataaaggcttcagcatataaattttggaaggggtacaagcattcactccttaggatctatttatgttctgaaggtcccactaatcactgcaaagtagctgggtccagtaaacatgttttctgcctcttcatgtctctccttttctcaaaactcaaaatgacctcaagtcttcccacatctcaaaccccatctagccttaatcctgtgacccgtgatctgttccactctttctaatgtaggtgtagctggcttctctagacttctccttcagttctcctttctgcctattgatcatcataaacatcaaaaagccaggtgtggtggttgcctatgtcacaaagggcattctccttcagcaagcaggactggggagtggctcaggatgactcacattttagtatttttctttccatgctcttggtttgccatgccccctttgtctccacatcacttgtcttacttgcccctgatagtatttgagtggcacagacaaaaagggaactgccaccaccatcaggtctcaagagcacatttagcacctgcagagctccgtatgtgcaaaccaatggcccagcactgacatttttggctcccgctaattagctatttccccttccaggatgggtactgccctctgttttgcccaaagtaaatgaattaagttgtttccatacttgaggccaacccttttgtcagcagcagcaacttaattactctccccctatgaggcagagctggagctggttcaagtgttccaccaatggccagcaggagaaaaaaaaaatcattagaaaatcaattcttatttaattgaagatttttcctccgaatggaaataaagtgggatttatcactgcagtagcctcacagcctgggtaatgactgcacttttgcctttctgggtttcccttggtagataagatgtcttcagcacccaggctcagcagcaccacacacgctgacttctgagggtctgagagagctaaggaaagcaacagcctggatgatgaatccactcaggatgtgggccaaagctgtacaaccaaaagatgatgagaaacaatgcttagaagtaagatcaatacaggagactagaacccgttggtctctcttcttgcaagaaatttaaaatagcatattttttagggctgcttatttctcttaaggatctgctattgcctatagcattgagactcccaggaagtgctgagtcatggtccccagcatttgctgggacaaatatgaattccatctagttatgggcaccacactggtactttgacactccaggaatggtgaccagaatgatgactcacccagaaactacagcattggagggagaattgaaagcattgagagctttttgttttgagaaatgaaagttcagagatgtgagaggtgtcttcaaacctgtgaatggcatagccttgctttgagttgctgaaatgggtagaactagggtactcctcacagggaggtggaccatgatgtatttaatgcaggagctgttaacagaactgcttagaaaagcttaggattgtgtttagggaagctggatttgaggaagttaatatttcaaggccacaaattcctccattattcccctcaaacaagtgtctatctatttgtctatcatctatctatctatctatctatctatctatctatctatctatctatcttctatcatctatctatctacctattgatctatcatcttatctatcatctatctatctcaactgaatggcaaaccccaattcaacaagccctctatcaaaagatcccctgagaaattgttagcatagtatttggagaaattagaccatgctaatatctattttaaaacttcagttgctcctgttttctgtaaggtgaaactgagaccattggaaggagctgcaatgtctgtttttcacaatgcaaccctagtctactcctctggtttatgtcctttccttctctctcctataagacctctttatgatgcggacacagtgatattatagtccttacccaagaatgctatgcctttttccatcagcttacctttgcccattgagaaggctgcctggaaaccctttctcccgtttgctttgggaaatacctattcttcgagacccaaattttgtgggtcttgcctctctgcaccaagaacaactcatgccagcattttaacagtcttcattattttatgctgcaaatttgtgtttgtgtgtctgtctctcccactagagtaagatcacattcaaggataataatcctgtcttattattttggaaaaattgtctctacaagacctgtttgaaggtatcagattgattatcacgtgttcatgcccagaaatacatgaatagaaattagtttgtaccatgagtcacacacttggaaataaaatacaagatagttaaatatcaagtagaaaagtgaaaagaactttaaatttgtccaaaggatatcaaatataattgccatggtagatcaagagctgtgaaagagccctggatgtcttataaagactgggaggtgaggataacaaataatagctaccacttaattaagaaaagcatgatgatagctacccaagtaagtgattttgcagatattgcctagttcaatgcttacaacaacacaatgaagtaagaactaatatctctgtttatgaagtaaaagatgaagactcacagagtcaacttttaatgccacacaacaattagggtgttggtacttggctttaaactcatatcagacatgaaatgccattttcttcagcactacgcaataatgtctccctagataaatcaagatggcttcagaaacatgccccttggatggacctttgtattagttatcaattgttgtgtaatgaattacatcatagcatagtgtcttaaaataagagatatttattatctcacaatttctatttggaagctatctgagtgcagcttaattgagagcctctgcctcaaggtctcttatgaggttgcagtcatgccaggtcttgggctgtggtctcatctcaagtcttgactgggcagaatccactcctgagctctctcacacgaccagtggcagatttcagctcctccccagctgttggccacagacatcagttctttgtcacatggacctaatctcagacacgacatcccatcacttctatttgctagaagcgagtcttgaggttcaattatactcaaagtgggggactgcacaaggacaggaatcacgggaggcagagaatgtgcatgctattttagagactgcttcccatccctgaaccacttgctgtgctctggaacaaatggcagaatgttcaggggaggggatgggaaagtgaggctgtcatcagcctctgaggacctgaagggcatgagctgcccacagtctgaggaagatttctcttatttactagcaacatttgtaaagcctccacatcacgaggactctcaaaagctgacaaggtggagatgctcaacctcattttcaagtgttcaaactcaggcttagagatgctgaggtacatgattctgctatcaaacacagaaggaactctcagatgaaatgctgcctggaggtgtgatgacagtcaaagagagaagaatgtgatactgtgatataacaagaaatatctatttggtctctacctccagttgctgagacaaagctgctaaaacccttgtggatataggtgctaggagaatcttgtcttctaatgtttggtctttgacaccagtttctaaaacagagctcctaaggcctttgtaatttcctgagttgtaggaacatctgatacagagctcctaagttccttgggtgacagaagcatcttttgttctaatggggtgacttttcttgggttcctggatagctcaggatggggttggttgccaggggaaccaatcatgtgattagagcattgaaactttcaggctcactcctgacctctggaaaggatagaggggctaaaatttgagttgatcatcaatggtcagtgatgtaattaatcacgcctacatagtgaagcttccataggaaccccaaaagacagggttcagagagctcccaaattgctgagcatgtggaagtccctggagagtggcatgcctagggagggcatggaagctccacatcccttctcccaggcttcaccctatacaccttttccacctggctgttcacctgcatcctttgtaatagcctttataatacatgaatcaacaaagtaaaatgtttccttgagttctctgagccactctaacaaattaattgaacccaaaaaggggttatgggaatgcccaattttttggttggtcagaagcaaaggccataacctgtggctagagagactagcatgtgaagtgagggcagtcttggagactgaggtctcaatctgtgagatctgatgctatctccaggtagacagtgcccaaattgaatttaactgtggggaacccagctagtgtctctcagagaactgtgtggtgtgtagggaaatatctacacacattttgttgacaaggggtgaagtgttctgtgctgcattgagtgtgtgagagtaggaaaaagtttgttttttcctattacttacactttgtttttttcctatctcaaacaaggaagaaggacagagggttcctatgctgggggaaggtagtgtatgaccatgcctgacctcccagcttcttccgctgtgctgtattcctcacttggcatgtatctgcaagttgtttggagtgacctttctcaagatttgtgtgcatcaagaccggggtctttacagtatttcaacatttggattctctctattttcgttacaagaagcaaagccccacctgcgacacactggcctcaactttgttagataatcaatagtacactaatgcaatggattagaaatatgtggcaaaggactggtgcacaaactttttgttaatgaagcatgactgactttgtggctacctgaaaatgtccttgggccagctttctcccacgtccatattttcatattgggttcccctataagtggtcattttagacctctgttagccctcccgctagaaaataaccattgttgtcagttctgggtctagagtgttcccaagtctgttcactttctaaccagttggtctgaaatatttagtttgaaataagaaggggaataatgtatcattgggataaatcaggtatgggagaacttatcaaagttcaataaacataaaagtgatgaattttgaagtcacacaattaactcaggattacatgtgcaataactgagtaattacacctttaataatgcattgaacttgtcaagaatacttactcattctgctcaaattttttttaacaagatagcctatagcaagtgactgtaattagatattgcctctgaaaacatcgacagctcctaattgataccttttattataaagctagatgccaaacatttgctgttgagttgattaaggaataatattagatgtgttgagatcataatacctacttgcagaaatctcatgtaagtagaaaaaaaaaatccagttcgacccatcaatcacccaggtaaagttggttcaagtttgcactggtttgctttaaattacagcctgacagcgattgctattgccagggctgtcaggaaaagaaactaggggcagaagcaggtgggaatggagatggggtcccaaactgcttccttttttccacgtggatggtcaggagagatggcactgggagatcgcagatggcaaaatgtctccatgtggcgaggggaaggagagactatatttgctcttgtcttttgacgaaagattatttttttccacatcaaggttgatattaaggacttttttttgttgttcttttgtattttctcaacagctgtttgagacagggctctaacattcataaagataaaagagagaagctgtggtttaggagtgtcggggagtttccccagcctcagccccatctccagggtttcttctctgtatagtttcctctaaatccagagttcctattacagggaagccttgggaacattttagaaggaggcagatgttttcataggcattagggagcaggtgaacaacctccagatagcaatcacctcacggcccatgagaggcaggtttcaggtagtgaagagcttgagctctgccctgtttggatccttctcttccagggttacctaccatgggatctgaagcaggtaagttgagttgatcaccaatggccaatgtctttatctgtaaaattatccttacagtccagaccctgctgatgcagtgccagggcatgggtacagatagtgaccctcataccaatgactacatatttaaaagctatatatcaagccagcaaactgtggaatcaaacattttctatcctcctactttgacagaaacaccttcaaaaagaaaatgtgtaggccgggcacagtggctcacgtctgaaatcccaacactttgggaggccgaggcagttggatcatgaggttaggagattgagaccatcctggcaaacatggtgaaaccctgtctctactaaaaaaaagaaaaaaaaaaaaaaaatagcagagcagggtggtgggcgcctgtagtcgcagctatttaggaggctgaggcaggagaccctcttgaacccggaaggcggaggttgcagtgagccgagatcccgccactgtactccagcctggtgacagagcaagactccgtctcaaaaaaaaaaaaaaaaaaaaaaaaagaagaaaaagaaagacagaaaatgggtaaagctatgatacttatatgactgaaagacatccaaatataaaaggtggccaaatgtaattgttactgcatggttctggatgtgctattagtaaacagagatactgggttagtcataaaataaagatgcatattatttacaaattattttgtatttattccataaaaattatttattcctttgagttctcagcaaaatcactatgttactataatcaagattttcacagaattttgttctattggcaataatgacctgaacaattataacataaaatgtgatttattcaaaatgtgtatatattttatatatttatattttacatccataaaaatgcaaactaagtcaacgttggaaatgttaaaataattttaaaatgtaaatgtaaaaactaaaacatatattttaagtgttctcagaaaagtcagtattctacaatattgaaaaatactaaaagcaaaaggaaaaatcgattacttaaataggcaacacaaaatggaaagtgtcatttaataacattaaataaaatgacattttaatgtatttatgatttaattaagattttgtagaaaaattcaaacaaagccacaactctaggattcaatattcatctagttgtcggtgtaaaaatgtggtatcatgcttcatgcatgttatgtctagactcacatatattcaaatttcaaagttctatgaattgcttaacattgcaaaatattccatggctgttctgaggggctgttgtgaatgctggactgatttgtgaataactcgagactcaacattggaacacaaaaagaagcaagaaaatggttgcaggaaatgagacttcgttacagaagaatcttttgcattcatgcagagaggaaagatttgacaagctaacagatttctcttttgtctcctctcaaatcctcctcaatcccagagcagtgtccatttctgaagacagcagcacaactcacagacctcatgacatttaaatacagtctcctttggtttcaaggtcacccactgggcaagaggggtgacgagtatttccctgggattttaatcttgttagtcgtaggggtggctttgtaggacactggctcccgcgtaacaaagacattgtgaggtatataactttttttaaaaaactttattttagaacagcttcaggtttacagaattacgaagatatactttttgaagatacaaaagtgctatatgtttccatacacccattttccccttttattagcatcttacattagtatgacacatttattagaaagaacccatattgttattattaactgaagtccatattttactcagattttcttcgttttccccaaatatcctatgtcaattccaggatcctatccagaataccacatggaatttagttgtcaggtctccttagaatcctcttggatgtgacagtttctcagacttgttttgtttttgatggcctagacagttttagattactggctaggtattttgcagaatgtccttcaattgggatttgtctaatgtttttctcataattagctattggtttttcggaggaagaccacagatggcattcgcatcacatcatatcatcaaaagacgtgtcactcttgatattgaccttgatcacctggctgagttagtatttgtcaagttacctcactgtaaagttatgtgttttttcttcctttccacatcattctctttggaagggagtcactatctacagcccacgcttaaagactgaggagttttcctctaccgccttaaaggcacagtatctacatacattatttgtagttcttctgcatgggaaatttgtctctttctttccacttatttattaaataattcatttatatcagtatggactcatgaatatttattttatactttagattataatccaatatgactttgaaacattctattgctcaagttgttttagctttggccactgtgagtcctttcagctgggtcctgtgtcccttagacatacccccataattgtgttgtttttcttttaatctcgtttgaggactgtcttacttttcagcactacatgatgctacaggcttatctcatgtattttttttttttttttttgctcctgtcctagaatcagccatttttccaaggagccccaccatgaggtttcaataaatatattgttacctgtatgctcacaaaatgcaagttccaggcccaggagatggacctctcttttccaggtccaagagtaatgcaggttacactctttacatcatggagttgaaggaacagttaaaagagttcacgtgaacaaagtgcttggaatagttcctggcacatagtaaaagcccaataaatgttgactatgattatagctgcgtgcaatagaaactttctcatgtctcaccagtgaatgctgcctgttagcagcaaccatggcagtagaagtaggagccaatatttgagttatactctaccatgcagaaccatccagagattactcacatccagagatgatttctatggtttattctctggagcaaatctttttagttattgacccatatgggtttccctgtaagtaaagacaagtcatctgttacctatctcacctgggatgagttgcccagtggcaactcaggatgagaaggatgttctcatcctgctatgaagaaatatccaagactgggtaatttataaagaaaagaggtttaattgacccacagttccgcatagctgaggagacctcagggaacttacaatcatggcagaaggcacctcttcacagagtagcgggagagagaaatgagtgcccagcgaagggggaagcccagtataaaaccatcagatctggtgagaactcactatcactagaacagtatggaggaaacaacccctgtggttcagttatctccacatggttttgcccttgacacacagagattattacagttcaaggtaagatttgggtgcggacacagagccaaacctcatcagccagtgtcttttatttgaactcttttttttatatgtaaatgtcttatgtagtgtcatattctacttgcactttcttgttttccttgcctctactctgtacactctagtcttttggtggcttgatgctgaagtggctcccttacctctgctcaacctgatttctggctctaagaactccccctctctaggaaggggaaaactttctgttggaagttgaggcaaaacactccaggaggggacagctccctggggctgtacagagtgaccatgtatccaaggcttgctggagccagttgaagtcctacctcggtacttttacatttaacatcttactgcttaagtatcatttaccaaaaaaaaaaaacatatatatatatatatatgccactgttggaatgtaaatattttggaggaatttcagtcagttgggtaaataagataaatgcatgaaactataataaagcattctacagtagctgtcacattactgttgaggaggagaagttctgtaggagattggtaaggagaaaaaaaaggagaaagacgttacacatttcctgggtagagctacagagctgctaagggtgtggacgctggaaccagatggtctgggctcaaatactagctctgccacttgtaagtcatgtgaccttagacaagtcatttaacctctttttgcttcacttccctcatttggggatattttatacctccttcagaggtttgttttgaggataaaatgagtcaatatgcacaaagcacagagaatagggattggcacatattcagagctatgtaaagtttatgctatttttactaggtgtcacatgcaccatgcaagggacttcatgggatatttcattttgccttttatgcaaccctgacagggctacttgacctaacttttaaagacaaactcagagaaagagaggctgaggatcaaggatgcttatgtattggtaggagtgaacttggcatatacgaagccaaggagtcccatttaggtagggagaaggatagtattaggtagctaggaacagttcctagaacctgctgaggtttggtggttacactctgtacatcatggagttgaagggacagttaaaaaagtttgagagtaaacatagatcccaaataatgggatgcagtgactagattgcctggggctgcaatccacctcttccacctactgtgtgaccttgggcatacggcttaagtactttggaacctcaatttcctcatctgtaaaatggagataaccagttctacctcctggggatagtatgtgtttatacgcacttatctgtagaaagtatttatctttatacatgtaaaaccatttttacatgtatatcttttttacatgtaagtggcatttatctatttattccatgttttttctattctgtggttctgttatttttagcatccaacgtcaatataatagcaggtctttagaggccaaggaaatactgccactttcaatgtaaatgttaaatataaaatgaatccttgttacagaaaggataaaatataaaatgaacatctgtctcagaagagagaaatggagcagtagaatctcattaagcatctccccctctctcctccacctcttctgctaaactctccttctaaatgacagacccacttcttgggacttaacccacagccctgggcttccccaaactctgcctgtggtgacgcccaaggcaaggcctgaaggagcgtgtggagctaagaagtggacttgtagctcaaaggaggtagaaattgcagtagggggtatacaaattcttcagctttaaagaacttcagagttagacatcattaaatcattaaaagggcacctaaggggagttaatatgcagaaaagtagagctaatttgagctctcaagtgactaactcagaattgcccacttaaactctgaaccctttaattcatatgagtacattatagattccaaagaagacttttttcccctccttcaaactttggccttccctataggcagggcagagggtgggggtagctttcgtagagtggagctcaccacccagaaactctgcggtataaatatgcaggcaagggtttttgttttttttttttttttttttttttttttttttttttttttttggctgagagtaacaattaatagctactgcctggagctcctcactaaggcacagattttagtagacttcaatcctgccaggacatcctgagataagattagatcagtggttttcaacagaggatgattttatccccctgcgccactccaggagacatttggtaaagtttgaagacagttttagttgtcttggcttgggaggcaacagtgctactggcatctggtaggtggagtcctagaatgcacaagacaatccccaaaagaggattatctagcctcaaatgtccatagtactgggactgagaaaccctgggtaagaccagcagaaggtattaggttggtgcgaaagaaactgcagttttcgcaattactttcaatggcaaaaaccacgataacttttgcacgaacctaccaacctaataatttctcatcaggccactcttcctgaatgcagagagctactgacatcctccgcgccctctgcttccaatttctagctctgacaaatgtggataaatatatctggattttgaactcagaatatcttgccttgaaattcagtcactttatatttctaagcctcagttttctcatctgtaaaatggggattacaacagtcatctttgggttgttgtatagaatttagtctttatgcagtaagcactcaatacatgctaactgttattactgtcccaggattgaagcatccttgtttaggaaaacttcacttcccaaagggacataaaacttcttccaggtcatgaacttctgaatcctaggctccttttgccattgctgatcctgccacttttcctcaggcctcattttcttccaaatgcaattgttgcaatagggctagatggccaacttcccccattttaatcagaatctctgccagaatgaactattgaaagtgacagtctaaacgggttattctcatgccaagtcttgccacagcgcccactgcctacaaaataaaatttgtttcttatcatgccctcaaggtctaactcttaccctaaactcttaatatttgctgggctccaccttcaactattctcaccatatgctgtttctctaatatattggtccatgtcttccttctaagcttctgtttttgacattgcctctctctcttgagtgcccaccccttcttaagttgtcctatcaaatatttatttcccaagattcaggcgaagacacagctaggaaactatcactaaagcccaaggggggtctaggcttcatttacttgcatacccacggcacagagggcatgctttagttcaccaaattccttgcagtgttggacttttgggaaattgtctgtttcactcattgtttgtttcagaaacatactctcctggaaataaaacattggtatcagacttttctatccctctaattttgtcaggagtccgttacagctacaaaacttcctaaatctccagctttattttcctggggttaagaaataaaaccccactctgttccttcttagctctatgaccctgagtgagctatttaacctctcttagcttgttttctttttttaaatctgtaaaattggactaatagtctcattggtatctttgtgcatattaaatgagaaatttacataaagtactcagcacaatgcctggcactagtgctcactgacaactatttttcaaatggtagtcccttcagccttgaagggagaaaacagagagtttgaagaggtgagcagtagaccaggcatgtccatggggtacaattattcacttggaagataaaggaaatcaggaggtggagatgagactctttaaaaaaaaaaaaaaaacaattttgctatggttgagtcatgccaggctggactgccattgcctgggctggttctagagcatgtacacgtgtgtgtgctcatgtatgcctgtgtgcaggcatgtgcgtgcatgaatgagagatgaggggctcagtattgagcaacacagtttaggtttagaaacaggattcagccatgggcttctgctctgaccattgggaaaagatctgaacccttcaaagccaggataagggtctctaaagtaagaaggtgaacaataaaaccctggaagacccaaaagcagttgagaagcattacagcccttttgttgcaagccccaggaaacaggggaaaaataaacctggtctgacttcaccactcctgaaccataaaatgtttacctcgggggagggtagggacccaaaggaaggaaggttttctgttgtcaagctctcttctaaggatgtatcctgacccttgtcctcaggtctcctgggcctgaacaccccagggcctggagaatgctaatgcagtgaagggcttagccattcagcttctgggctgaggtcagcttctgctcagcactgagtcctggggagccttccttcctctttctgttctcgaggtctccatcactgtagggaggccatgactctgtcattctgtggatctgattctgggtgattccatgttgccccacagggtctgggtcagaacctacaccatgctagccttgtcaaggcagggcctctcttccctggggctgtgtctctggcttcctgcacttcctgttctctaagagagccacacaaagcccaatgttaccaccagctcctgcctcatcactctgcttgtctcctgtgaacttgttcctggtttgtttcagaaatgcgtcgatttaatgtactgcttaaacttacagatattggggtcagatgtgcagagttcctagtgggatgtccttggcagaaaatttagcttttcaaaagtttagtatcttcagctatcaggagggaatgatgacagcctttcccttataaagcggatgttgtaattagaggtgagaatgcaggtgaagtactgaactcggtacgtggcccgctgcaactacttggaatgaattgttaaatgacagtgtctgggtttagcccttttcagaattgctgtcactttacacttgaatgccagttcacctctcggggtgtggactaagctggaagtggttctgggcagcaggaagcctgttatagctctatacggcatgattctctcggctttaaggagatgggacttccctaacccctccatgtccatgtggtcattctgccagcttccagagaacatttatctgagtcccttgaagtcccagggagcaggtcatgcagcaggacgagaagactgtggctgaggacctgggacaggccctgtttctggcaccatgtctgtgttccacatctgaatgaggctgctggggatgctagaacagcaatctggaaagcagggagggttgggggcatcatacacaatggaactgggatggaaagcaggcctgggccacacacaggcttagagagtagaatggcctgtgagtctcagagattcaagtaacaggtgggccagttgggtcagtttggatccttgaagaaacagacatgaagaagagactagatacctaagagatttactatggtttgggggtagggtagggaacatttctacaatataagaggggagaaagtgaaatttggtggggaaaggcttcagaccatgatgcaggtaacacaccctaaggaaggacagaggaagagaaggattgggcaggagaaagttcacactgtggcacagttctgacaaagttctggccggcccatggcaaagttgcttatgagagggatcctgagtagggcaggaatagccctattctgatactctctgatgtgctcggtcttggctgggatcagtcaggggaactttggcctgacaataattgaagcgcggattcaaaggtgtggcagctggggctgtcaaccactcatgctttcctcagcgggttcctctgggggagatcggagcagagcagctccatggctgccataacagctgaaatgatttctttttagaagcttcaatcatgaaattgtctgtgataaggctgatggtctcactttccaactgacacacacacacacacatttactcactatgcatacatgagtatacagacaagcataaacaatacacatgcagatgcagatacatatagtgtgtcatgacataaatactgaacaagattcgagtctaaagtctggtatgaacaagatgcatagccttgaaaaaatcccttttattgaatttatttttcttaccaactatataattagaggcagcactcagacctcatttgactctatcattttatgagtttatggattacagtactcttacaaccagtatcagtacaaacagacattgtcaatggaaagttccagccaggcagagaacaaagggcacactcattcctttaatgtacattcatgggcacttcgggtaggttggtgaacaaactgcatggttcttgcccttctagaccagtattcaatgggaatacaaagagaaagaagaaatgaagtaaacaatggtgggcatttgtagaggataagcaagattcagtatcagagaactgtcgagagggggaactcttgagagatttcacacaatgttcatttgttcaacgtgaagggcaatttatccattccacacatatttatgggtcatttgctgtgtgccaggcatggtgctctctgttaggttaagtgagttctcagtcaaaaccatggacaaaggcgtccttttggacatcttcccagacctgcttggctctttgttaaaatggtacttgtcacaaacttgttggtgcaactcctgttaacaaaagcattccacagctcacgttctttgtgttttatttcctactgtgaaaacggcaatattaagcaagcaaatgaaaggtctttggcatagagtcagaggactgttgctttcttccagttctgccacatattagctctgtgctccagctgaccatgctgtctttctggttctcagtttacctgttgttaaggtggggatggaatgacatcttccatctcatccagttcccaggttactgcataaaaatattgtttttttctgtggaattccaacaagtctttctgttttatcaattcataagtgtatgttttaattaaaaaatattcttcaaagcaacaaagaagcaaaagagcaattatactgaatcccaaccaattcctcccagaaaatttattattattatgctgtattttattttttgagacagggtctcactctctcactctgttgctcaggctacagtacagtggcacaatcacagctcactacagcctcaatctcctagtctcaagtggtcctcctcacacccaactaatggttttattttttgtagggaagaggtctcactatgtgtcccagactggtcttgaacttctgagttcaagcaatcctctcgcctcagcctttcaaagtactgggattacaggcatgggccaccatggctagcaggaaattatttttaaacaaaatttacatttggctcccaattataccactttctagctatatggccttggacactttacctatttatttagagcctcagtttctccattgggaaaagagtttccaggtagatcctccttctgtgcttcagtgttttggcttagaggtagaggtgttttggcgtgttttgtaaatccaaggagaggctctgactagagccagcaagcccagctatttctagattctgatagaatgggtttcctccttgggcatctctctcgctttcacactttaagaccctgaggttgcagggaaaatagggtgacttttgttaaagagctgcaactcggcagttgtgttggaggtcatggtgcttcgtcagaggcagcagtaatgtgtttatttatcactgcctactgaccatatgtcccctttcccttcagtttgttctgcccaaggccgttggggtccgacagagatcaacagtgtttctaccgagatgcagcagctcgtcaaaacctgaattagatgttaaatctttttgaattggggaggaggtgaagggagggaggaatcatattgtgctaagaatttatcctgtgttgtttcctgtgagataatgtccctggaaagatttgttaccaagcaagttgcaaactgctgtttcaggctgataggtgttgccaattcattttgatgaattctgccagtcagaagagtatttttcccttctttcatttgctgaggttggctggagatggacaacggttttaagagctgagatggcacacactggcatgcccagggtatgtggaatcaaagatgctttgagaaatacttggtgctgcacagaaaagtaaattatcaggctaaaaatggtctatcctctgctctcagctcccaacccatgttctcagctgctgcttttcctagttacttactattgctccattgatcctcccctcccagactccatccctgtaccctgctagcttccaaacaaccctaatatccccattcccgctaggtggggaagaggtacaaccaagtagactctggagtcagactgaaccaggcagaagttcagtaccctctctaatgggctgacctggacaaattacatttctgtgaccaccaatttcttcatctgtaaactggaggtaaacataggctgggtctccctcactatttgaacttgcactatctgcaggcttgctatccaaacacaagcgctgaatagattcagatatatatttaaacaaattccttgctctccgaacttttgctcctcactctctaaaactcaggaacaaaacaggggtgctcctttttatcctcacttgctctccaaacagatacagattttgaagcacacttgtactggtttataaaatttagtgtgaaataatgtcattaaagtagttcgtacagtaccagttaataatgagtgctcaataggtgttcacgaggatgatgaggacaattaggcgaccttgaaatggagaatggtgctagtttggcacttaccttgttcctggatttccttggaattacagaccttcggcaaccccaattactacctcacatactggttcttccatctcagcctctccctatgcccctgctcatttcctaggcactttttctgagctgttgccttcccttccccttgccagtcatgagataagtgcagacctgtccccctattctggcagtgttgccagcccttagactcacactaaccattcctgggtctacaatacatcctgggcttcatactcttgcttctagaggggccttgtctttccaccttgcagatgaggcagctcctcccacttctggcccagaccctgcccagtgcaattcttcctactgcgactaatacatctgtattagtcagttctcacactgctaataaagacatacccaagactgggtaatttataaaggaaataaatttaattgactcagagtgtagcatggctggggaagcctcaggaaactaacagtcatggtggaaggggaagtaaacaggtcctttttcacatggtagaagcaagaattgcccagcaaaaaggagaaaagcccctttttacaaaatcatcagatcatgtgagaactcactcactattatgagaacaccagcatgaagttaccacccccatgattcaattatctcctacggagtccctcccatgacatgtggagattatgggaatgacaattcaagatgagatttggatggggacacagccaaaccatatcaacatcctacaaagatgtccaaagacaactgtcaaatccaaattgggcatttcagggttagtcacagccactctgggttttattatattccttttgttcctcactctcagccaatccgctttctctttgtcttgtctttgccctagcttttgcctgttaactctagaagttctttgtctctttaaaattggcacctttgatgctttctgctaatcaaaacctgtggccatggtgaccctgtagaaagttggagcactagagctgccctcactggcccagggagtctctgttggtcaggctcatcccctgaaccacttctggacacttccatcccctcttgctcgtacccagcttcctccttatggccttgcagctcaggatccacaacttctgttttttgcttcagttttccccaaggaagcatcttagaaattgtctccttgactctgcacgtaagaggtaccaccctttgcacctcccatggcctttggttacccccagcagagtgtcacttgtcctgctgtgtcctgggggcagctcagcattttgtcctcaggtctgtgacactcctgcagaaatgttgttagatagatctatccttctcccagctgcaagattcaagcacattcctctcctctctgagcctcagtttactcctctgtacaaggagagtgagaagtgctcaagatattgttgccttttcctggggtttctgttattttctgggatttctttttgaatagggttgttgaggattaaatagtttatatatgtaaaacatgtaagagactaccacatgataagtgttcctaaaagaaactatgaacaaatccagtatagcaataagtattttgccaatagccatgttgggtggtatacaaaggggacctatgtaggctggggtgagggttccaggtgggttccttgggctgggaaatgattggaagccacagtttatcttaagggatctgcagcacaaggggagatgaggatggggctgtgccaggaggaaggagcacatgatagactctctgactagacctctctcgggactctcagctacttttcacctcttggactctgctgagctcttggattcctcctgttgaacaggggcaccaagggggtctggaacactaagagaagctctctctttgttcacttgcacttttctgttatattgattcttaatcagccatttttatgctcttatgggaatagcctttgaggtcttctgcaaatgtcccaagtgcaaaacaagatcaaacttcctcttcagatttctttttatcctttcttttttttttagacagagtctcactctattgtcaggctggagtgtggtggcatgatctcagctcactgcaacctccacctcccaggttcaagcaattctcctgcctcagtctcccaagtagctgagactacaggtgcgcaccaccatgcccagctaacttttgtatttttagtagagatgggttttcaccatgttggccaggatggtctctatctcttgacctcatgatccacctgcctcggcctcccaaagtgctgggattacaggcgtgagccactgcacccggccgtcctcagctttctaaattcttcacttgaccttggtctagagaggcaagagtagaaccccatctctcgctgactgcacccttctttcttccacaatgctccaaggtcaaaggggcagtattcatccttaagggaagaataagcccatttcccttcctctttattcctccctctttccaaagaagtatcccacatcctttttccaggaactacaatggttgacaaaactgagatagagtgagagagagagaaactagattatctataaggtgtattaagaagcattgtatttattatttagaagtattatatttattattatagtattattataattcagaagtattatattcattcacacataatagatgtccaataaaaatttgttgaattgcacaatgtggttgaaagagcatggacttgaaattcaggctggtctggttcaagtcttggctttgccacctactaaccatgtgaagtgaagactggcaccatggccatgaacagaaatgaaaattgtttatgccacatcactggagtgattggagcaaattcttttcactgtgctttgtacaggcataaacttaagattttgttttacaaactgatgattatattggctgttaacagagcttaaatcctggcatttagaaacctactttaatacttactcaaagactatctggtcagaaatactccccttttccttcttgaaatgttaaaattcaataggaaagtgacccgttcaaagatgaactctattttataaagatgttttcagtgggccatgggtaaaaaaatatttcataaaccaggggaagccactaaatcaaggagtgaggaaagaaatagacttgctaaagcagtaccatattggtgtgggaaggcgatatattcagtactttttactatatttggctgcaaactcaagacagtttttgccttgatctatgactgagattcagtggcatgggcaccatttgaactaatcctcctcggggcttcttgctctaacaaggagaccataaatgatgacgattgggtgagtattttgaaaaggagagaaggaggtccttttggctgcaaagttctgatggattcatggagctactgaatatgcctattggatcacaggaaacatgcaggtggaacatggattgctaacaatagaaggcaagactgagactaaagtggattcaggaagaaggtgtctctgctgtcaggtggattactttggaaacaggctctgagagagattttgcaggcaggtttataaggaatacacttgggatctgcacctgtggatggaaggagaggaaagcagaagaagacagaggggaaaatacagctttaatgtagcccaaagacaaccccagttgaccccattgggaaatctggtagaatagccttcaaagttgaccccagctgggctaaagtggctgggtttttaaactgtagcacccatcagttgagtccagggtactccatgaaagagtgtggccttgggtgagatggatcacttgggaagctgaggcaattgttgaagaggctgacaggtgaaagatgttgctcaatggtgctcattgaaatgctttttggagaacacatcacagtatccactgagatctttctcaagggctgagaatgccaagtctgtgcatacttggttgcaggtttatatgctaggtttgaagatccaactattaattgattggataaatccttgctatgttagagatttggctaagaagaagcaaagcagttcctttcaatcatccagactgctatggaatctttcccttcctgcaagcatgagtatatagactgggatatcattgttgttgagtgtggactctggaaacagatgaactaccttcaaaacctagctcagcaaccttccagctgtctgaccttggaacaatgacttgacctctcttaactttcattttcttccctgtaaaatgggaataaggacagtatacaatttatatagtgttgcaaagctctttctttgtgcatgcctcacataattagtagtcaataaaagttagcagttgttgttatttgtcctcttagtagtatatcagagaaaaggaaggatttacccatttttttttctaatcctggtgttagcacaaagacagtagaagtcccagcctgggctttgtgggcagaggtcctgttagggtcacaagtgtacttctagagagtctctagggtcagctcctcttgaaatcctggagatgactgaaaccacaaaattagcttctgggttgtctttgcagggtattctacttgattataactataaggcaccttggatcatctcaatgccaggaattatcaatgttaggccctgaagtttcagttatatatgtgtcaattcaatacatggaaccacatgggtgtatctgagtatacttgaatgttaaggaccagtgattctcaaagtaggtccacggaccagtagagacaaagccacttgggattttgctagcaatgcaaagtttcgtggcctcccacagacctacagaaactctgagggtagactccagccatctgtgattctgatgcatgctaatgtctgagaatcaatggtatagataaggggttggtaaattttattgtaaagggccagagagtaaatattttaggctttgcagccaatgtgatctttgctacaactactcaactatgttagtataatgcaaagcagccatagacaataaatgaatgaatggtgtatggctgtgttccaattaaactttattttaccaattaaactttatttaaccaaaactgccaggccacagtttgtcaatttctggaataggcacatgtaggatcataatttactcccttaaggtgattatttctttctctagaatatgttcattcattcatttattcaatcattaatttaatttaatttttccattgtgtgaggatctctgcatgctaggcattctgataagaatcaagagatgcaacaataaatgggacagacaccatccttctatcatagatcttaaagtttaatgctagacacaaaaaggtaattcacaaataactgtcgcaataactgtatgacataaaggatggaattagaggaatgatggggtgaactaatctagtctagggagggtagaaaaaagcctctccaaggaggtatcctttaagatgaagtcctgagggtagtaactaggtgtatattacccttgtacgagctttgtcctcatagctcattttatcctcacacaactcaataaagtggacaatattattattcatggttcacagaggaagaggttgaagcccaagaaggacaaatagtgtgctcccagatttgaacccaggcagtttaggactagaggcagtgtttttaacgacaattctctactaactagttaatgggaaagagaagaacattcaaggcaaagagggcagttcacagtctcgtggggtactcactaatttcatcatttcattttggggagcctgttgtaatctaggcatcatgtttggtactaagcatgcaacaggaaaaaagaaagactttctgcttttatgaaacttacaaatgagtgcagaagacagacattactgaaaactagggggaaaagggcagagggagaatggaaaaggtaagagaatacaacggagtgaagagaaagatctgaggctttaatattgaacagagaaagggtagagagattaacaccaaatctcctttcctcacttcttttgtcaagttatatctctagggcttttgatgattaaatccaattcttgatcaacaatagctggaaaagaagtctctgataaaacatttttacctgtaggcactcaaatggagaactaaaatgaaatgaaacatgtaaacttgaagtcacagttgaattacaggttgacaattgggcactgaatatcagttgaagatataattgctcctctaactgccgtttccaattgcagggcccagttgtgacgactgagctccactaaaatgggaccaagtataatgatatgagtaagttgaaagcaaaaggatgtaaaaagatatacttagcaaatattactcagagattaataagatattctgagagagaatctctgatatctatgagtgtgactcagagataatgcaaggatggctatgttaatatacaaaacaggcttcagagcaaagaaaattactagctacagagagatgtagtacataatgataagtcatggtaatactaaatgtgtatataccaaacaacagagcagaaaacatgtaaagcaaaagctgacagaactgaaaggaaaaagagatgaatccatattatagttgaagattttaacactccctctatttcaacaattggtagaacaactagagaaaatcaccaaagatatagaagaattcaacaacatcatcaaccaacagaatctgatttgatatttatggaatacttcttccaacaacagaatatacattcttttcaagtgtccacaggagaaatatttttattaaaaacttatacaaatttaatataatttttatcattcagagagtgccctctggccataatggaatcaaactagaactctttaacagggagataacagacaaatttgcagaatcttgaaaagtaaacaacacttttaaataatgcatggtcaaagaggaagcctcaagggcaataaaaatacagtaaaataaatggcaatgaaatataacatatcacaatatgtgaatgcagttaaagtagtgcaagagggaaatttatagcactaattgcttactttagaaagaagaaaagtttcaaattaataataaaactcacatttccagagccttaaaaaggggagaaaagtaaatccaagacagtcataagaaaggaaatataagccaggtgtggtggtgcacacctggagccccagctactcaggatgctgaagtggaaggattgcttgagtccaggagtctgaagctacacagtaagttataattttgccactgtacttcagggcaaaagaatgagactctgtttccaaaataaaaaaggaaataataaagataacagcaaaaacaattaaaaatttaaaacaattaaaaaatcgatgaaacaaaaaactggttctttgaaaatatcaacaaaagtgacaaacttctaacaatatttacaaaagaaaaagagagaagacaaaatattgacatcacatatgaagcatatatcacaacagaccccgtagatatcaaaagacatataagaaatgctatgtataatacattacacataaatttcacaacgtagatgaaatggaccaatttctcaaaaagcaccaactaccacaattgatccaatatgaaataaatatttgaatagccctgaaattattaaggagattgaatttgtaatttaaaaacttcccccaaagaaatctccaggcccagatggtttctctgtagaattctatcaaaagtttgaagaagaattaaaacgaatactatatgatctattccagaaagtagaggcagaaggaacattttctgattcatttcattacaccagtataaataaaagaaaactatagagcaaatattcttcgtgaaatgaacacaaatatttttaacaagatattagcaaatataaaaaatatataatacataataatattatataatatgtaataaaaataatacattgtgactaagtggaatttattttagaaacacaaggctgtttaaatattcaaaaatcagtcattgtaattcaccatattaatggactaaagatgaaaaaatcacataattattttgatgatacagtaaaagcatttgacaaaatttaacatttattcaggtaaaatcacagaaaactatgaatagataagaactccctcagctaaattacatatatatatatctataataatctactgttattattatacataatggtgaaatattgaaagtttcttccctaagatcaacactaaggtgaggatgacaactgttaatactgtcctttgacatagtgctgaaagttctaggcactgcaataagacaagaaaggaaattaaaaacatgtagatcagaaaagaagaaataaaagtttcactctttgaaaatgacacaatgtctaatcccaagaaattaacaaaaacttacaatgaataagtgagttccaaagttttcagaatattagatcaatgtgcaaaaatcaactgtatttctatatactaataaccaatatgtagaaatccaaattaaaaatatgatactgcttaacaattgttaaaaatgaagaaatacttaaatatatattgaacaaaatatgtatgggatttttattccgaaaactaaaacactgatgtagtaacctaaaaaggaaattttttgaaatgttgagacataccatattcatgaattggatgacttaacatattaaaaatgaaaattctatacaaattgacaggtttaatgtaatttctatcaaaaccccagccaggcattttgtagatacagataatattattctaaaattcatatggaaaggcaaaaaaaaaacagtatagctaaaacacttgaaagaaaaataaagtgaaagaaaacactctaaccaatttcaagatgtatcatgtagctaagtaattaagactatgtggtattggtagtgggtaggcatcgatggaacagaataaaaaacaaaaaaagtcccatataagttttgtgaactgattttagacaaaaatgcacaagaaattcaatggaggaagggcagtcttttcaacaaatggtgctggagcaattagataatcatatgcaaaagataaatctcaacttaaacctcataccttatgtaaaatttaactcaaatcatatatttaaaagtaaaatataaaactataaaacttttagaaggaaacacaggagaagatcttcaagactgagtggttagtgaggacattttagacatgacaccgaaagcacaaacaatttttaaaaccggttaaaaaaggtaataaatgcaacttcattaaaattagcccaatgaaacagaccaaaattagtctgtgaaaggtccttttaggaggataaaaagacaagctatagactgggagagaacagtatttgcaaaccacttaataaagaactcatgtgaaaaatatttgaagaattctaataactaaatattaaaaaacaatctaattagaaaatgtacaaacaacaggaagaattatttcactgaaaagtgaataacaagcatctcataacgaaagatggttaacgttattagccatgaaggaaatgcaaattaaaacaaaatgaaatatcacaacacacttattagaacagctgaaataaaaaaaagtgaaaataacaaatgctgatgaggatgtacagaaactagatattttaaacactgctggtgaaaatgtaaaatggtaccgccactctggaaaatagtttggcagtttcttaaaaccataccactcagaattacactcctggacacttatcccagaaaaataaaaagttatattcacagggactgttcatgattgttcaaggcagctttatatgtagtaagtcaaactgaaaacaaccaaagtatcctttatgggtgactgactaaacaaactgtttacatttacaccgaagaatactactcaccaataaaaagaaacaaactattgatattcataacaacctggatggccctctggggaattacgctgaatgaagaaagccaatctcaaaacaccatatgctgtactcttgtacttacataacattatttaaatgacaaaattataaaaatggagaacaaattagtagcaaaacaaaaataactatgacgcattggagacatatttgtattaagtatggtcgaaggagaattaccctctatgctacaaaaaacaattcctgcaaacagaaaaggaaaaaaaaatccataattttaaaagttaaatatggacataatttcaaaaagcatagacagcatagagctcacaatatagaaaacaaaaatggctaataaaggtagacagtgtttaatctcagtggtaaccaaagaaatttgaatacaaaatcaatgtgatacagtttgtcaaataaattagcaaagtttataaaaacaacaacattctagggaggttatgatgagacaaaatactttcatccataattactagagtagaaatcagcatacaattgggaaaacaacctgggaaaatatgtcagaaaccttaaaaatatttacaccctcgaccaaatatttgcactttctgacatttattgtaagagcacagcattagtttcttagggatgccatacaaggtaccactaaccagcagacttcaacaacagaaaagaattgtcttgcagttctggaggtttgaagtctgatatcaaggtgtcagcaggatgtgagacagaatctgttccatgcctctcctctagctgctagcggttttctgtcaatctcctgcactccttggcttgtaagtgcatcactcagaattctgccttcattcgcaggaggtgttctccctgtgtgtatatctatctgtgtccaaacttctgctttttataaagataccagtcattggaatagggcccacccatatgacctcatcttgccttaatcatctgcaaagatcctatttccaaataaattctcattcacaggtacaggggattaggatttcaatatctttttgggaggcacaattaaagccataacagacataatctaaaattcaaaacaacaactttattttagtataaaggaattcatgttatttattagtataaaatattaaaaataatacaaatacataacactgtgaaatagtcagatagtgctgggattacaggcgtgagccactgtgcccggccaaagcttgggttttatagacatggacagaatttcctgaagaccttgtttcaatcctacctagtggcttagccacttcccctctctgaacttcagtttatccatatgtgaaatgggaggacaatgcgtgatgctgattccagagaacattttgagggtcaagctgaatctacccctacccttggcagcctctgctacaggtacgtcgtaaccctctgatgtctaagctgttccctcctgcatattcttctaccagtatcctatttctgaaatagtgaagccagtcctattccttcttaattctttctgctttgtttgcaaggttctaactattcaaatttaatttctctacttgcttccattccttgactttcaggatattatttttatttattttcccatggaacgtttgtaagtgttgaatgattttgttatggaattgtgaaattagggaatttagttctggaatggattccccaaaagataatttattcagataattatggcctcactcttcctttgaagaatactagtatttaaatatttaacaatattaattacaatattttatatttatatattgcataatatattattttaataatatttttaaaaataaagtgtatatatgcaattgtggccagaatttgtgaactgttgttgatactcactcaagacattgcagcagcaaaaagattcttagatgtattaatagagggctatgttaattccccactatattttctatttgcctcaggaaacaaattgccatttggcattactattgttttctgagaaagaaaacttctgctaaattaaaggctgcttcacgagctgatcatcttgattcatttagcaatagaagtaggagtcagaggttgcaaaactgttcatcacagtatgggatgagtaatttgaagtctgccgaattgaggaggcatggagtgaggaagagagagggagtaaaagcaagagggtggggggaggagaggaggcagtgggcactgggtgggaaggagtcccaggtgtggagtggcttttctttgcagacaagaaagctaattactataaaaattcctgttgtgtgatctctttgtgaaacaacagcttgatttgaagtctactacattaaaaatgctgcatgtgacttatttctgttctatattttacttgctaatatgtatgtgtgttttaattgatgagaagattgatattcatcccacacttaggtggtcaggaatcccagaggtagaggaggccacaagattctaatgattacaggtacactggaatttggagaaatcttggggaggccacaagctacacaactgggaattcaagaaaatcatgcctatgtctccagggttatgaagcttccagctgacctctggattacataagagcataactaccttctccctctggtaggagcaggaccctggaatgcctctccaccctattctcccttcctcttgggctgcagctgctgtagcaattgtccctagggcctcttttaggagagaggaagcaaagcctccaacctacacgttttaaaggactttttaattgaggaaaggttgcacaatgcaaatgaacaatgggtctcacttccaacctcccccagaaagaagctgctccttgattgacaaaggaaggaaatggaagctagacatttcagaaaccagcactagaataaagagatcaatgtgagacacattgcaggataggaaaaccaaaactatttccaatcactgatccaaggctttcctttcaatctcttacgggaattagcattttagaaaatgaacaaggcagccttgaactacccagagaaatgtgaacttctgagccttctggtcactggacttgtctttggatgaaaagagaagaaataaacgtatattgagtacttgctgtgtgataggctctgtgagaggtgcttcatgaacactatctcatttaataccatttaacaatgtccctatgaagcgtgcataattatctcactatataggtaatggatttgaggctcactaaagtgactatttcagtgaatgtgtcaaatactgctgaagtggcttgcatgtgatcattttgggaagatggtcaggctggtagctactgtattggacagcacacatttatagaacatttccatcattgcagaatgttctattggtcagtattattctagagaaaatataagagcttgaaacagtcccaggcagtagaagagggtatttgcaaaagtgggagatatggtaggagtaaagcaggacattggtgctccaggaattaggcagaggttcataatttagggtcttgaaatgcaatatatggaagatccaaaccagggagtagattagatgatccttcaccgagactcaaggatgatcaagttggaggatattaggtgggcaatgctgctcagtgggtggagcttcagacagactttatgcctgcattttgaaggtcgacatgggaaatatgccatgtagtcatctttgtcccagctgggtaaggaactggtatggttgagccagcactgacctaacagggcagagctgtggcaggaggggttgaaaacagaaaccttcacctcattttatgctcacttgcagaatctgtgagtgagtgtgtgtgtgtgtatgtgtatgtgtgtgtgtgttggaaaggcaaaggcaattaagcatgctttaatccttgactgagtagtttattttcttgcgtatcctgaattccagtttgaactctactgagtgcatcaaattggaattgaaatcttagagaggttttagcatccaaataactctttctcttctctttatctgtgagggtctcctttaaacctgagtccactttgagctttcttatgggataaaaagatgagttggctagggcaataaaacaactttctctttaaatccatgttggaaatgtttacctagcttggtcataattatgcacactactctggactaaatagaaaagaactaagtgatataaaggacttacattccagtaacctctatattagctcagcaataattccagcaaaaatgttttcatcagctcagtttctgttttcagaatcagctcttgagctatctctaagaagcagttaaccactattattgttagcatacaccaaatataattataggtaaaatgcttgaatgagatacttcttgtaggagaaatggagtctctgttaaattcttgaatactatattcatgttggagatttgcaaaaaactttttaacaaaaaaaggctctgagaagtcctgcagtaaagaaacctttttccccttcctgtgtccatgtgttcccattgtttaactcccacctatgagtgagaacatgcggtgcttggttttttgtctttgtgaataaacaaacaaacaaacaaacagaaagaaacctttttaattctatttaagccagaatttcctaaattagctcggaaagttttttattttattttcttgtttgcttttctgctttcttctttgttatgcatgaaacatctggagaataaagctctatacagcatagtttgagaaacactagcataaatacggcagaataatgatatggagtggaggagatgtttgtgtttgggctgtgttttactttcaggaaacctgaaacaatgatgggtatttgggggaagttatagttttcatgagcctgtcatgaaaaatctgagagaaactcttaaaactttgtgattgcttctttaaactattgtccacattttattgttgagcataaactctacactaccttttatttactagttcaatttcaaacattagcaacttaatgatcactgcaggcaaaaatttaccttctgctgtaaccttcagaggtattttattcaatactttgatgaagcttatggtgaactgacatgatttgccaccacattagtttcttaccatctttgtatattatcatggcctcctaatttaccttcatttcttgcaaatcaccttcactgttccctaaaactccaccgtattactatgacaaaggtcatcacagcaagagttgtctacttgaaccacatcatcactctccactggcaacaaggcagtatatacattaaatatgtacaacttttaacatgccagtcatacctcaacgaaccacaaccagtttcttggaatcatttgagcttgtgacccctgtcatgcctttgctagtgccagtccttcctcttgatgagtccttttctcaactcactcatcaaacatctagtcaccctccaggacccagttcaattgtcatgactcctgtggaatatttcttgatatttgcaggaaaagttatttgttcctttttctgtgctcctattgtgggtttttgttttttgtttgtttgtttgtttttgagatggagtctcgctctgtggccaggctggagtgcagtggtgcaatctctgctcactgcaacctgtacctcctgggttcaagtgattctcctgcctcagcctcccgagtatctgggactacaggggcctgccaccacacccgggtaatttttgtatttttagtagagacggggtttcaccatgttggccaggatggtcttgatctcttgacctcgtgatccacctgccttggcctcccaaagtgctgggattacaggcgtgagccaccgtgcctggcctcctattgtgttttctatttattcatacttttggctttgatttttaaggcataataaaaattattggaaaaaaatcctgtgtcaaagagaaacttgaaaaaaaaaactatattgaactccatcttctcttctagctttatttgacaaagttacaccattgccaatatttaaaagtaccacatacattattccccaagcatgaggttatatgtgttacaaacattttctcttcaatccttaaggcaaaagtgaagattttatccctaccctccagatggctttatccaagtttgtctagctccaaagatctgtaaccttttcactatgtaacactgcctctcaggtgcatgactagccatgctgtgtgtcactcagcacacttcatatttataataattgcttttaattctcagataatccttcaaggcaatattagtatccatatttataaccaaggaaagtaagtcttacttgccctaggtcaatatagtagtaaatgttagcttaaaaccctatactttttccggtgtatcacacagcctcagctttccactgttcaggagacagcatcctcgggtttcaaatggacaccaggaagctctattggatctttagtcatgaaagttgattcagaaatcacactcaagggtgcaacgattaaccattaagaacatacagggaaaagaagaacatattaaagaacaccactggctaacacaaacaataaaatccaaacaacctcatttcaactaacatatttcaaggaaaagaaagggagacagttagaggaaggggaaagagagagagggaggaggagggagggaaaggctgtagattaaaagataattaagtgcatgtgtgaccttcattatatgtgggatctaaaatagctaaactcatagaagcagagaatcacatggtggttgccaggtgctgagaggaagaaacagaaagaggttgtcaaagagtacagcatttcagttaggcaaagtaaataagttctggagatctactctacagcctagggtccatagctaacaataatgtatcgtatacttaaaatttgctaagagagtaggtcttatgttacatgtttttaccacatataaaaaatgacaataataaacagggcagaagaaaactttggaaggtaatggacacatctttggccttgatggtggtaatggtttcatgggtgtatacttatctccaaactaatcaagttgtatacattaaatatgcacagttgttaacatgtcagtcatacctcgataaagtgatataagcaaataaattgcaatgtacatatctatttcaatttttattttgattaaacataaattataagaagatcaggaaaaatctgaatactgattgtgtatttgataaaattaattaataattgttcatttgtgggtatgataatgtgattgtgattatgtttaaaaaaggaagtcctagatttatagagataaatattaaaatatctacatatacaataatagatattttggatatgctttcaaacaatctgggacagaggccaatggatagaattccggataaaactaaattggccatgagtctataattcttgatgctggatgttggggttcatttttattattctaaattcaaaccttctaattaaaaaaattaaaaattactaattagccgaacatattcattccttgagaagggttcatagaggctttgaatgttttgttgtcaataaattaagatgtaaaaggagaaaatgtatctttcagccatattcttatccctatagccagattcttgttttaccactcaagagcaattcttttttttttttttttttgagatagagtttcactctcgtcacccaggctggagtgcaatgaggcaatcttggctcactgcaacctctgcctcccgggttcaagcaattctcctgcttcagcctcccaagtagctgggattaaaggcacccgccaccatgcccagctaattttcatatttttagtagagacggggtttcaccatgttgatcaggctagtatcaaactccggacctcaggtgatccacccgccttggcctcccaaagtgctgggattacaggttatgagccactgcacccagccaacagtgattctttaggactacctacttagccataaattggcaaggcaaaaataatcacaagcatttctccttgtgcttcatgttacttgttgtcatggcagcctgtattttgaaaatggatttgaatttgcccctggatgtattaaaatatattaatttttggcatggaatgaattttagttttgtatcatgtcatcagtataaaagattccaggagagaatttatgtttgccaaggtgccattggtgtgataatattaagagtttccatagtaattcttcctactccagtgctaatttgctctcattgagcatatgttgggatttcccagaaggaagaagttagatggaagcagcatgagttggacactgggagggatgaactaggcctgcttcagaaagagagcagtcactttaatcaccaaatccaaggagtaaagcaaagtcacattccatctgggtcaaggttgatgtgtgaggagtgttattgcaggaatgggaaagagtggcaaaggggtttggatcttagcagagtcctctttattctctcagtatcagactcattcaacaaagggtcttattcaagatgtggtagggctgctcaaacaaatgcagggcctgtggagggagagcctggcttggggtcatgatgctttcccgggctacattactcaaagcctcaagagcatgatttgccaacatggccttaccctgggagtgtaataaatgaaagaactggtactggaggccagccaggcaatcaggccttaggcaatatataggcgtttgggaagaaaggactcatatagacacctgagtatgcattctctctcaccactatgcatgttgaccatcatatacaaaatagtaactatttccaaagctttctttcctcataggcagggaggtgctgacaccctcctaaattaggtctccattgccctaggattgggtagggttgtggatgctggtggccagtagtcagtgcctgccactgtgctggtcagggctagggaagttgagtgatgggttttttccaactgcttcttttctggcccatgagaacaacggaaggcagcatgacctggaagatgagatgtggcctctttgccagcacagtttagagctgaacctaaggctaatgctctgggccaatagtcattgacctctaaaaccaaggcttccctgagtcagggagcctcaaattctgcagtctgcactccacactcttcactgtttacttatctgatggagctgttctcttggaaagctgtgttattcctgtaatgcaaagtgacagagaaaataaaaacacccagctgagaaaaagccacaatgttaatgtgaaacacaaactttctgttcatctgaatctcagtttattttaaaacagaaccataacggctcagatcctgaagactgggaagcactgttgctacagctgtcccactctcagatccttctctgacttgccttctggtcttaatccttagcacttttcccaggaaggaatgtcaagtcaaggtggtaagatgtcagattgccctccctgaatatggcttaaagaccaagttaagagcaaattcttaagtttgcagtagatgaaccagaaactagtcaccatatgctccccactaacactgaagtccctctggctgaataaaagcttggcctgagtttcccaggaggtttgttctggatgaatctggcttttgtgttccatctgaaccaagttcggggtctaatcccaaactctcacaagctggcattgagcgacatctgtttggcatcttctataccctgttttcttggtgtttgcctgcattttttggaattagctcaattttcttatttttttttctggatggtttctgaacagtactatccatataagaattttagtcatataaagccctagggagaaccctgctatgtaggctgcttcctgtcctcattccacccccaaactggaaaaacaggagcccatggtggaaaacaaagagaagcagtccaagtattagaagaaaagcaggaaattgtcccataggagagtgtttcatgaagcaaggatgcaacaatacctcaaattacacctctctaagaagaaagtttaaaaagtccctactaagttaagaattagtgaccttaactaagtagggttgtgatggtaaactcagaatgcaataaattaaaaagtgcatgagaatgaagaaaaaggagatactgccttttcaaggtacttgctctggagcaccagttcctaacttggtgtgcacactagactcccctggagaggatttaaaaaatattgatgcctgggcttcatcccggagattctggtttaactagatttaggtctttgagggagcatattttgttttattttatttttaagatgaaaatcacttgacctatttgtagcctaactataagtagctaggagaaagggagaaattaaaagtacaaagggagtggttgggtaatgatgtcatgggatggccaaaaaggcagccgctgggatccaaagttcaggtggttgatcttagacctgaagaggtgaatcaagaccaagggggcaaggtggcttcctttgccaatgtggaccttcatctggtggtttttagttcatgacgttggaggctaagctattttctgagaatcttttttgaccaaaagcagaggatctgatgacatttttggcttgattggccaacacagccttaccttgggagtgtaataaatgatacggggaaacgtcttccctggactttagtatgatcacaaatgctttggtgatggaatggggatagggtgaataataaaagcttactgacagtaaatgatgacttgggaaggaaagactgggcctaataagacatacctgaacccttccatgagaacttctaaaattttagtgacaattcatttaaagagcaattggtcagtcaccttaagttggtcatggcgcgttgtgctggagaggaagagataaacccagactagaacaaaccagtgagctgggaaaaatgagacccaagaaaacagagatgcccctggtggaaaaccatgaagacagtgtggaaagtcaatcagacaaagtctaggggagaggacaaggctggcagtgaggaagtgggtgagttccaggcaactcttgtggccgctgggtcttttctgtggttctgtcacttcctttgtaagtggatgtgacatgagtcttgaagggacagataagaatacctctcaccagggtttatcattattggttcacatctgtcatattcagtagaatatgtattttttaaagaaattaggtttgttttgtataaagattagatgtatacaataaaaatattaagtaataataaaaatcacgaaataaaaaggaagagaatccctctacctctacactatgaatcttgcttcccagaggtaaccaccattaatattttttgggtagggattcttctgtgtgcatgtaggcataggaaaatgatcactcttgtaatatcgatttttaaggctaaaaaccagataaatacataatactgtgataaataagaaaaaagtaaggtgctacaaatgtctaacatagctgcttgggaaactgacaaactcagttttaaatggtatgtataagtggtgaggaaaatacgctaaatgtatatgagtggttctgaggaatagtgaatgaggaatcactattttatagtcatattctctactggtgaagtcatagatagtcatattctctacaggtgaatcaagagggattatcacattttgcagtaataattttacttgctctgaagcaccattgagaatggattgttaaagagataattggtgagcctttacctgtgaatgctgtactcatcaggaaccagcatgcacttgcagaaataaatcaggaattaagttagactaccagtgttgttttttttaaagggtctttaggttggtagctaaagaagaaatataaatggtgttcctcaaattaattgggggcttgaaatgtgatatcatgatattcttgtggacaagatggaggtatacgttctagatagtattgaagttggaaggacttttagctaacagcagtcaaggaatgttataaactaatcaacctcagctgaaagtgagagcagctctatcctaaggtctgtcttattatttgctttattttgactaatttctgggaaaacatatacaatgtctctggtacatagtagatgatcagtaaaaatacttgctgaataatgtgatgtgaaaatgaatgcaggaaaaagtgatcgaaggatgacatgaatttggaaggaacaactagctaataatctgggtgatgcaattaggaaacaaactaacaaacaaaaaacctcttggacaatggcccaggtagatcatccacctgccgtgcagtaggtgaaaagaatgaaagttctcacctgctgcatttgttctttcatttgatttgttctttcatgcaaatctcagcttctgaagcagagagagcaggctggatggctgcaagtccatttcctgagcttttttgttccctggctgtatgctggtgcaacactgcaatgaatttgaaggaaattgcagagttcccccaaatccatcctgtcttgtctggtactcccagagagcaatcatggttagccattaagactgtatcacctttctaccgaacagtctcttcaagaaactgctaacttcttgtggcacccagtttgatgactgtaggaaggagtctccagccccttggcctctggctgcattcctggaaagacactctatctcttagttttctctcccctcaatttattgtcaaaccatgcaaatgaggcttccttaactatttcttggacatcttaaaattaaagtctgcacattaataatttgttcagcttgttggtaaaagtagcatcaatattatgagatcattggtctggcctgggttctctattcaaatcttcatttccaggagctaaggatgcccgccctcctcttttgagtcccacacccatcctctcacatatttatctacttcaattaagagtgggaaatttgttcaagaggagacagtcctgggggacatgaagggaatttttttgtcagggaggcaatgtaaggtctgaactatatggtcatcttgttgagagcagagtctctgcttgcttcattctccatcctttatattcttgttacttaaagtgtagttcacctcacctgggagcttgttggaattgcagaatccctctgctgaatcagactctgcagtttaatcagatcaccagtgatggtgatttgcatgcacattaaccttcagcagcatgggtctgtattacccaacaaagcgtggtgaaggaggaagtaggcagctaacatttattgtgtgagatggcaggagagagaggaaaggaagggaagaaaaaggaaggggaagggagggtaggggagaggaggagaggagagggcagggaagggggggaggaggggatggggagggaatgaaataatataaattcacatggggagaaaacagtctgaatttgtgacaagtatgacataaaattttacttagtttgcatatggtaacacaaacccattgttacaactttctactttagtaataaagtgaatattgtgcaccttaggagaaattactcacatatttacattttactttcttgccttggaaaggtatttttaaaataggttaaatatttccatggttctttgatcaatattttagaaaatggatcataaatagaagaaaagtgaattactccctagttcaggacacgttattaaaaaatccaagttgggccaggcactgtggctcatgcctataatcccagcacttctggaggctgaggtgggaagattgcttgaggtcaggagttaaataccagactgggaaatatttcgtagagaccctatctctacaaaataaataaataaataaataaataaataaataaataaataaataaaaattagccaggcatggtggtgtgagcctatagtcctagttacttgggaggctgaagtgggaggatcatttgagcccaggagtttgaggttacagtgagctatgattgggccaccgtagtctagcctgggtaatagagtgagaccctgtatgttaaaaaaaaaaatcaaattgtggagaacacttgatccattcatagagtaagcatgtttcaaataatatacagttgctctcatgaagctcatggtctagggtaaggaaacaaatctataaacactgttcccccaaacaacatattacagttactatattatatgctattaaaggtaggtaccgaaagacaatttacctttgccaagagtggggaagggactggagaggacaccccagaggatataattgctgaggttcatcttgaggactagattggagtttgccaggtattcagtcacaagacagcagtgtgtgctaaggtcatagagaggacaacatgtcttagggactgaggtgtgtggtgtggctgaaactcaggctttggggaaacaagaggggtgaagggacatgaggttggtgaagtgaacaggagctagatcagaagggccctgaatgctggtctaggcagatgaactcctcctgaaaggaaggtttggatcagtatcttcgttttagaaagataatttgagaggttatgtgtgtgatggatagataagggtggtaatggcaggaggaggagagagggtgatggtgaaggcaggtggagtgaggaagcccagtgaactgggctgttgcatttttaaaataagactacatggtcatggcagattgacttcaggcagtgaccaaccataaagctagaaagaaccatgaacattttagagacattcaggaaggattcagctttattatcctgtgactgccttatttgttgacaaaagttctccaacgatcaaagccccattcctgagatttttggcactggctgtagaaagaacaggaacattagaaagcccagaagctgttttctttcattactatgttttgttttgctcctcaagtaactcttgccattctgtgaagctttacagaaaatcccaagtatcttttaccaccaggataagcttttctctatagcctaagtttaataattcacagttgtgaacacatttaaagagtgaattcccagtcagcatgttcattgtgaattgacatagtttctttaaaggcacatcgtgggtagtgcactacatggagaaagaaatacaggtagggagttgagaagggaggcttgttgaatattttaaagagttgacgggaccccaaaagcctgctttgctaaatctgaacattaaactcagaagcaatgtcgcttggattcctgggaagcatgtgtcctggagggtggggattgggacggtgttgtcaattcttccatttgcattttctcctgactcttcacctccaacctttttgtattcagaaatgcaacctggctcatctttatcctcccagtactccagggtttctaaattgaggatccatagttctctgccgagtcttggaatattttgaaattgaatgcagactccatgtgtacatatgtagctttttgacattttcttggcagagtccttcacattacatgagattctcaaaggcatctgttatgtagcaaagggaaagaatcattgctctacacgttgtggcctatccccagccctgagcaagtgcatcatctccgtctttgtcaggatgaattccaaaaccctctttccagctaatgctattctagtgagctcctaaccactgtctccactgcctgtttggcagctggagacacacagcaatgagcacacccaaaacctgagcttgttaccttcctcctcaaccttgtgctcctcctttgtacatgtggagtaaaatgccctttatttgtttttttaccatctgcagtcaacctgtcattaattcttgataacattacctctgtttttgaaatttactcccttttcttgattctctgttacttagagaacccatccaatctacaggatgtaggagagcccattaataagtgattctagtcttgtctcctatcatcatgccaattcagactccaactgcactatgtatattgttcttcatctctctgactttgtgcaagctgttctctctacctgcaaagatctttcctttatcagatgcttgataatcacatctgtgagactccattcaactatgacgtcttgatgtcttcttgacaattcaagctactcctttcctccatgtgtatgaaatgtttctggcatagtacttaattcagtgagtttatttctctgtttctgtacccatttctccagctgggtactgtggttcagaataatattaaattacacaaattctagagttactcagagtcatggataacaatgcccagtccactaaacagcttattaaaatgcccataacttccaaagttctcccataccttctatacctttgctatgttaatcagtcgtaataaccctttaaaagaaaaccttttaacatattttctgtttatctcaaatatttccttcctttgtcctcaaggttgggcagtaattgggaaaaaaattctattttcctttctttccctgatcccactcaagttgagcaggccctggctccgtgcccacccacctttattccagatgttaccctggcgaacatctaagtctgtaaccaggcaaccattgggaagagggccttcctggctctgggcctagaaacaaaagaaaaacaaataggaggatgtcttgagtcttctacttactttggttttccaatctcatttcccccaaacttttattatttttgtaatggaaactgggggtgggtatctgggctgtctgttcacacaccaaatgtccggtctgttatggagcagggctctggctggatttgatcctattgatcctgatttggggctatgactgccaaggaaaacattcttactccccctctcaccatgttggaaaggaaagcattgaccatgtggccatgcagtgatgaagtttggggcccagctgagacagggctctcaggcaactgaatagcttcatgcagataagactaagcataccaaatgaaatttctgtggccagttagacatcccaaaacatctcttcagtgcacatccctcttgccctctttgccttctgcctagactgttgttaattgttgctgtggtttctttttaactgcatggcttagaattctaatcctgtcttcctgattctgttggagaagtcatcttagacataatagcatgaccccatttaaacccattcagtggctcttcttagcctacagcctaatttcctaaagtctggaattttgtcgttgagaagcataatttattcattcaacacttacttcctgagtacttatcttatgccaggtattgccattcttctaggtactgtggatagtccttgtaatcaaaatacagtaaaacctcacactcctgaagcttgtattctggaggcaaagggagaaaataaattaacaattaaaaaatacagtatgttggatagtgataagtgttatgaaaagcaataaagcaaggagagaggatgcaggtacaagggttgggggagtctgtgaaaatttcctgagaaggtgatagctgagaagagaaaagtagttggtgacagacccaacctagtaggggatatctgtgggagaactttccaggtagagggaagagtaagggcagaggcctggccgtgggagcatgcccgatctatttgagttagaacaagatgtccaatgtggctggagtagaatgatacaaggacagaggaaggagagacgagtttagaacagtggcaaaaggacgtactttatagattctttagaacattatgtggactttgcttgtcacatgcagtgcagtgagaatccatagaagagttttagattttaagaagagcaatcttatgatctaatttacttctagagggatcattcaggctcctatagaaaatttattgtagagaggcaagtggggagatttgttaggcatctattgcaatagtgtggcaaaataatgggggatttcgccagaattagatgtttttgccagtgcctcctctttgatgattttctccaaatagacatcgattttctggctgaatttctctggtcacaggaaacttgctccctactgtacttctttgggtatgctcagatctttagttattccttttacttttactgttcctattactgttccttttacttttcctattcgttttactgagacagagtttgtcttctataggtttctttccttcatcattttggtcctaccccttaagttaattaaaaacaaatctttttcctcccttcgctaccatgccatcttaggcccctcttctccagaatcagtatctccagtccctggctcattcattgcttaccattgtcccagtcacacctctccatcctgagcaccctcctgtgaaggctctttagctgggagagtggtatctttgccaacttggaagtcgggggctacagaaaagcaaaggctatgtagtctggatctttacccttcagtaacacttagtcacagaggtcagaagggtgactgacctctgtgctccagctgattattattattattattagtagtagtagtagtagtagtagggtctacttcatttccaccacctttttttctggggcatagtaagagttaacttctaaacaaactcacactactttgcaagcaacagcaaacacccagtgtaatactgtccttataaaatatgtctttccataatgtgacccaaagcatagagaatatttttactccagcatttcctgccattaatgttttccttttgcaatcttcacatagtgttatgagtgagttgtgtgttacaaaaagctacataaacactctcaccttgtaatctactgtaatggcattagtaaggcagctctgggtttcactcttctttcctaagtgtaacaaacacaaaatttttataccattcagcagtagaggagaaaaatatctcttaagaatgaggtgtaagaggtagacagcgctgtattgaggtggtactgccactctgacagcaactgagtatatgaagtttggcaaaattcccatcccaattggggagctaccaagtcatcacacatgcatttctgttggaatcattttatttctaccctaaatgataatagaacatatggatttggggatagcagagatgaaagccatttcttccttgtaagtttccactgagggattgtactcgccaaagaagtacaaatgcattttagatctacaatcatttatcaattatcaaacacctatcaaaatcatagggttggctctatattatgttggaagaataaaaatatgactcgagaacccgggaaggcggagcttgcagtgagccgagatcccgccactgcactccagcctgggcgacagagcgagactccgtctcaaaaaaaaaaaaaaaaaaaaaaaaaaaaaaaaaaaaaaaaaaaaatatgactcgaacaggcccttgaccttggtggactttaagtgagggagaaataaattatcccagatatttgcaatgctagaaagagatgcaaagctaagatgggtaaagaagaagtagtaattaacaccttgaagactatttagcagttctccaagaatataagtagaaaacatacacgagagctctagggatacagaaagggcatgaagttagtgttaaacaggcctaatcctggtttctggagtctgccctttggcagagacttctgtgttccactgaattgtctgttttccttttcttccttaagaaaaaaaaaatctcaattttatttagaataacactgaccactagaagtcaacattttccaaattcctttgcattttggtgtggtcatgtgactaattattgcctgaagagatgtaagcaaaaaggtgatacggaggattcttaaagagctgacagagctgggaagggcctctattctgcttctttcctgctctctggaatgaagatggtcagaactgaagccctggcagtcattcttgagatgagaggccacatgctaaggatagtagagactaaacatagaagtgtagggttcctgatgggtttgtggtatagttacaacaggcctgtatttctcacctatgaaactcttttacctgagagagaaatgatcttcagtctcatatatgtcattttaccttcagtctttgtgtctagcagtgagcaaactcccaactaatatgttctacttatgcagagcatgaggaccttcacacgggcgtccaatacacatacttcctcctctgctcaccatctcacctaatgggaaaatgcctaatatgaaactggagaaagcttagaatgattaaaaaaaaaaaagcattttaagggaggagagagggcatttgaaagggaaatttcaggaggataatccttttattttgtgaaatatatttttcaagtgagaactgaagaatagtcttgacaagtttagagaagatgtaaaacaattcatattgcccctttcttgatgagtcacttggggtaccatcaaggtcacatggaaagattttataagggttagaatcagtccatttttaagactagcctatcttgggcaatagataatagaggtggcctggttatagggcaaggcatgaaaaactagagagaaacttaatggatgacagagtcattcagatgtcattcattatatttaggctcttatgaaggtcagatggaccaggagggtctgatatcctggaagatatcagtttggtattgcaacactaagtaaaaagcaagtttcataagaggatggccagacaatgggctctgggttcaagtgttaaggagtaacggttaaaaatgatgtacacttctgaagaatggactcgcatttaggtagttgaaattttatgaaagaggagtcttaagtttggcaggcttgaggatagccaatgtttaaatagagtacatgtaaaaaatgacctaagagagattatcaggtaccagctcctcattcagacagctttagtcagaagtagtgtggcctgaggataggttgtggtttctacctgactcattaacttatttaataactttatcaggtatacattttatccattgctaaagacacaatgcaaagatgccaagattgagaacctacaagaggggcatgttgctgagaacctgaaagagggtcgtgctgctgagacagtgcataaggatgctccaacagacctcccaatgtgaaatgaaagtgtcaagccatctttaaaaaggtgagaacctctaggactaaaaaaaggacttgtacaagaattttcataatagcctatttgtgaaagcccaaaacatgataggcaaggtgtccatcggcataaacctgataaacagtctatgggatgtccctacaaggaaagctactcagcagtaaaagactagaactattgctatgtgcaccaacaaggatcaatcttgaaaactatgcttagtgaaagaagctctgcctatgttctttcctggtcagtctctaccttgacaccaccagaggcaataactgttctgtgtccttcactcagcgtgatgtttttgagatttatccgtgctaatactctatgactacatgtttgagtagtttattatttttgtattcctgagtggtactgtatcacataaataatccagagatagtttattaattcttctattgatggacatctaggctatttcgagtgttttgctattatgaataaaactgcaatgaactttattgtataagtctttttgtggacatatgttttcatttaccttaagtaaatatctaagagaccttcgagcacaggacaagtcgtatttaatcctgtaggaaaccactagtccttcctcaaatggtgtaccattttactttactttattttttatttagtttttgttgagcatccgttctctcaatcacttatcctttgagttacaaacaatccaattacactgttattttaaaatgtacaaataagttattattgactatagtcacccaattgtactatcaaatagtaggtcttactcattttttctatattttatacccattaattatctccatttacccctaagccccctgtgcccttcccagcctctagtaactatccttatactctctatgttcgtgagtttaattgttttgatttttagatctcacaaataagtgagaacatgaaatatttatctttccatgcctggcttatttcagttaatgtaatgctctccagtaccatccatgttgttgcaaatgactggatctcattattttttattgctgaatagtactccattgtgtatatgtaccacctttttttaatccattcatctgctgataggcacttaggttgcttccaaatgttaactattgtaaacagtgctgcgcacacataagagggcagatatctctttgatatgcttatttcctttcttttggatatatacccagcacagggattcctggactatatggtagttatattttcagttttttgaggaacctccaaactattctccataatggttgtaccaatttacattcccaccaccagtgtacaaaggtttccttttctccacatcctcaccagcatttgttattgcctctctttccaatataagccattttaactggggtgatataatatctcattggaattttgattagcatttctctgatgatcaatgatgttgagcaacttcccatatgcctgtttgccatttgtatgtcttcttttgagaaatgtatattcaaatcttttgcccagattttttcctatagagttgtttgagctccttatatatcccttgtcagatgtatagcttgcagatattttcttccattctgtgggttgtctcttcactttgttgattgtatcatttgctgtgcagaagctttttaaggtaccactttatgctctcaccaccaatgtatgattgctccacatacttagtaatatttagttctgtcaatctttttgacttttgctgttttggcaagtgtgtggtggtatttcgttgtggagaatactattcttaaatgtatgcattaaaatacacagatttataaagaaaaagcagctatcttgaaaaatatccaagtattttaaatacttgaaatacagaattgtgtatgcttttctatcaatatcaaatgacaagatgtagcatgagacctattaattttatatttttgaagctttaaggagcattcatagaatttcaatacagttgacataactgcattgatatgaaactctctgtggtatctattggtgaccaagcgaaggctattgctaccaccactctgttattcataatagaacgaaatgctaaatttcagataggagtcagtaaaaatgaagttggacattttttcactgaaatttacaaacccaaagactcttgtgcacagtctttaaaaacatttattagagaggatgataaaaataggaactcttggtttctatctaattctgagattctaggctgtttgaagcagccaactctaagataaaggcatcgagtgacttggacagaaaagatggctcaggggcaattatcaaggaagaaggttgttcccagaaggcagacagatggcaaggcagaaagaggcaggactaagggaagatggaagagcaacagcagagatgatgaaggagacaaatctcatgctctaacatagtggtttgccaccatatctgttctttagaatcatctatgacaattttgaaaaatgaaaataagtgtcttggttttactcctagagatttgatccaataatgttggtggggcctggaaaatagcattttaaaaaaagtcattggtagcttaaaggaacattggtggttgagaaccattactgtaaataggaagtttgtgctacggtgcaactgacatgtttgggcgtgaggaacaaaactggtggaacagaaggttagtggagttaaggctgggaagcagatgggtgatagggatggagccagcaagaaactgggagacaggataggaggatgtgcgaggcttatgtgctgtcaggcaggattcttcatagccttaggcagaattcaatctagctgggcactcaagggaggggctgctatcatcttttgttatttgtatgaatagtggtatgagctttacaacaattctaggaggtcaggttagagtgtgagtgccaatggctcacaggttcccaaaggcactggggcagagataaaatcgatcacaatttcagcccatgcgagaaacacttccataaatcacttggtagatgatgaaaacaaataatacgttccatgatgcattcactcttctttgagttgtccatatgttgggttcacgtgacagcaggttgaaggtgacatgagttcagattaagccagacaccattatacatgtctgtgactgaacagccctttctctgttcttgtattcacatttcaattggtcttcttgttcacttctcaaaatattgtagtaatgtagtagaaattaaaagagcttaacatatacttgaactcagtctgctatgttgaaatgagatggcagctgatggagattttaaatagacagagctttcatctctcctttcctcatttatactcagtgccaggtgctaataacgccagtgttcagaagcatccagtttccaatagtggtatctagatttttgtcttcttgttctgtgtcttagttttttggttttttttttaaaattgttgttgctgttgttattgttgtttgcctgaatgtttttgtagaaaccaaaggcatctctgccaactgaactcaataaaaacatacccccatgacaccagattggcctctgaacattgaagcagattaaacattttgctacactctcttatatagtttaaggtcaatggcatgcatatatgttcagttggccctatcttctataatatttaattatattattataaatatagtaagtattataatttttattataatttttaattatagaagatagggccaactgaacatatattttaatataatttggtttgtatagggaaaacttagagataaatgaagataacataaaataatgatagaacgttttgtaataaacagatcagaaaaggtctacatatgagaacattattctcaaaacagtcttcctgagaaactaattatataagactgccattgttcaatagacacctggaactcctttctaggaactgcctctggagctatttggttggttataaattgggctcaggaggcatatggggcctaccatgtgtgctttcttagattcacatggccatatctgcctgccaagctcccagatgcttgcttggtaggaagctccagctgccaccatcagtggcagtgctatcagcctccgcctccgcaggaataagggtggggctcttataagatttcaactgagccttccacagtgagagcctcaggccaagagaaccaataagatagagactatgtcttctctctccacttccaggccaagatgcagtctccaccattgagcataggagtttgctttctctacatccagaggaactaggtgacacaactctggggtatgggagtgttactgcctcgtgggaaaaacttaactaaaaagacacaggagacaggagggagtaacagataattccagatcccttctttctctgttggactattccaaggtgtggccattctttatggcatgtccaggaaaaccctgtatttatcagcaatcagagatgttttcttataaagtggtggccagtttattaaagtataaataccatgtatttgcctttattccttgcccttcccttattcctttgtgcttactgtcttgtgattgcacctcccaaacattagcacataaacttcatgttagttgttttccagggagcctggtccaagactctagactactgaattctcttatttataagactcactcaactcaaagaacaacatttccttggcattgaagagagcaaggagaatatgccagatatgctaaaataaaagtccacagtgtagtttcataatagaaacagtactgaaagcaagatttgtccatctcatgtgttggaaagaagaccacataattttggagttgcatgctctgatctgtttatttacaacaaacaaacaaagatacaaataatctgcaaatttttatctaaaacaatctctcattttcttattctgttagcccaattttccttcatagctcttatgaatatctggtattatattatcttatctctccttgtctcttattcatttactagaatgaaaatccatgtagaggtcttatctgtcatgtttacagattaattcctagcatcttgaacagaagacctaccatctttgaatggcaaggtcagaagaaatttaaaatatttatcttggctgggagtggtggctaatgcctgtaatcctagcactttgggaggccgagatgggcggatcacttgaggtcaggagtttgaaaccagcttggccatcatggtgaaaccccgtctctatcaaaaatacaaaaaacttatctgggcatggtggtgcgtgcctgtaatcccagctactttggtgactgaggaagaattgcttgaacctgggaggcagaggttgcagtgagccgagatcgtgccaccgcacttcagcctggatgacagagtgagactccatctcaaaaaaaaaacaaaattattttaagcattcatttattgattgatttattgattcatggatttaatagacatttattgaatactcatgcaagcggacatgtttcctaaaattccttctacagtaacactacaaaagtgtctgggtatattccttgcacatatttcctgtgactgagagctcactaacctgaacagtatgatgttctggtttcaagcagagctgatattcagttaatgtgcacctaaaaaaaatgaactagttggtaatatagtgaaatgctttcaggtaaataaatagtaaactagtaactgtgagaaactatataattaatttctaatataatttctaatatgcactccttagttcaagttaattgtcaaataggcgtcacaatgacaataattaaatagattttctgacattgagtaatttgactgagtatggatattattgaataaaagagtatctcagaccatgttagaagggttagaaaactttgaaagtaattattagttcagcagaagctgcaagaggcttctacaccatgaatagcctaattttgataaatagaacttgtctatttagtgatcctaaatgtatctaatgatgtcatgacagtagtggccacaacagtatcagttcctgacagcagtgtggacacaggttctgagaaccccatacaacagctgactagataatgtgacattggtgtgaggatgtgtgacccagaccactgctttagagtgacccagagttggctgtgaaattgcaaggaggcatcaaggggcaggcactccagatcctgagtcatgtggaaagtgttgagtcatatggaaagtgctgacatccaggggtgggcctgggtgtaccacgaggtcagtactcagctgccctctggatgcaataaagcctggacatcaataacctaatgattcttgacttcatgggagtcagtggacctgctttacaccatttctatgtcaaaccatggctcacataaggacgtcatttagttagagacccatatccgaaaaaagaccactccggaaatttttaaaaattaacatgtgatttggaaattgttctaatgtttcataaacgttgaacatcatgactcgtatgaatgattatgatgttcagttagtagagtactaaaaattctacctatgcttttgtcagtgttgtaatttcactaatactttttattactatggcaatgctttttaaagttgtttaagactcataataagttgcaaaaatagtgcaaaattcctgtgtaccctttactcaccttcctccattaataatatcacacataaccacagtacagtgtcaaaatgaggaaattaacatagtatcatactgttaacttgattacagaatttgtccagattttaccaggacttacgtgtactcttgtgcgtacatgtatgcgtgtgtgtgtggtttacctctatttttaaggactgtctttccttacaatctctatgccaaggtcatggagttttagccattgctaggcagaggtggagctatacatgactgcgcccccacataatcacattcctttcatttaagaatattcatcccatatggagaaatagaccatgtttattaatcactccagaaagtatgtaatttcattagatcaagctctgtctctgggcattgactaatagagggaacggctccccagcgacccagaacccctacgacacggtctgtggagaccatactttggggccagctgctcaaatgcactgctggaattccaggcagaaatgtgtaatggcatgccaagggctgctgagctgtcatagtccaagcagggttatttgtggcttccaaagagaggctgtaaccttttatggtatccacaaatctcagccttcaagagtcagggagaaaatgcaaccatgctgtttgaccgagctaactctttccccaccttgcccctctcccactcccaccatcactctacccccaaccctgagtagtctgcatagctgtcccagggcaaagaacatggcatgagacattacctttagcattacctcagggccagataaaatggccaggcatcccttctgattcaatgagggaaagtcccagaaagttgttgacaaagtagaaactttctaatttgaggtcctgaacattcattgttctttctgagcaagacagaaaagttttacttattggctggggtacttttaatggcagctgtaggccagggacagtcatgtctacacatgtactctcttatcattgatcaggcccattagaatgccagagctaaagaatatctctcctttgctttgcaggcacatggagaagggtttcctgttgtcccttttgacataaacacagtgcttgaagtatcttttctggcaacttctctgatccacttgtatgtgtattcacttatttcattcaccaggagagtcaaatgagtgaaatggttacaaatggtggctctggaatcagacagacttgggtttcaatactacctctaacacttattggctgtgtggccttcatattaggatagaaagttcacatgttgaacttctaatccccagtacttagaatgtgactttatttggagatagggtctttacagttgtgccctttacagttgttcctaagaacacctaagattggtgtccttaggaaggggtgacattggagacaggtacatataggaagaacaccataataacgcgaactcagagattggggcaatgcttttacaagccaaggaatgccaaagattgtccaaaaatcactggaagctaggaaagaggcccagaacagatcttccccttactaccctcacatggtgccaagccctctgaccttgatcttggacttctagcctccaggactgtgagaaaataaatttctgttgtttaagtcaccacttagtatgtggttctttgttacagcagtcctagcaagccaatatggctagttacccaactttctagaaattcaattttcttattcctcaaatgcaatgactttagcagtgattctcaaagtgtggtccttggacaagcagcatcagcattatccagaaacatgttagaaatgcaaattcataggttcccaccctagatttcctgactcagaaatccttggggtggggctcagaagtctgtttaaaccagctctccggatgattctgatgcatgcttaagtgtgaaaacttacgatattgtagaaaggattctatcaaacaatatatgcaaagttcttagcatagtgcctgacatacagtaagatatgacaaaccacaagacattttcaaacacttatataacacttaaggtggttcagcatatggaggtgtaaagatctataaattttgatttctcaataaactggcagaactcacaactttgggaaaggcatatttgcaacaattaacaaaatgctcttaggtgttatgatattgttccagatgtattttgggaagacagtagacataatggggcagtggaaaatcagggcagaaggtatcaatagatagacaaatgatagctagatatgtttacagatgattgatagagagacataagcataggaggcaacaaaatatgatttatttttattagaataatgtttgctacacaattcttttttctttaaacttgtatttctggctgggcacggtgactcacacctgtaatcccagcactttgggaggctgaggcgggcagatcacaagatcaggagatcgagaccatcctggctaacacggtgaaaccatctctactaaaaatacaaaaaaataaaaaataagccgagcatagtggtgggtgcctgtagtcccagctactcgctactcgctactcgggaggctgaggcagggcaatggcgtgaacctgggaggcagagttttcagtgagccgagattgcaccactgcactctagcctgggcgacagagagagactcccatctcaaaaaaaagaaaaaaacaaaaacaaaaaaaaatatgtatttctaaattgattctcacaacagatctgtgggaaaaaacactataaggagaataaaaataacacccagctattagggaaatactatcaatatttaacatattattgttaggaagattaaattataccatgcatgtaatatgttcagaacagaggtaggcacatagtttgccctcacgaaatcaaacctcattatcattattattattacattgttttcattgttcaaatatagaatgaaatttcagaggggacatcactggttaaataaagatccttgtttcaagtcctgtactaatggtttccatccttggctatttccgctgtgttgtgccatctctcacatgagatattgtaagcttctcttagccccatcacagtcctatgattgccctactaaaatgtctgcccctgaaacttgtggatccttttcaaacactatactgggatatcccacctcattgctcagtggcagcctgttctgatgtccagtgtccaaaaaaacagaaggtcaagccctacggttatgaaacagagacactgggagaaatctagattccatgcaagggtgacactgaccaaatgtagtcttttctctatggcgtaaatgctaagaatgagagagtgagttacttaggtgttgggagcaagccccccaaaatctggccataaactggccccaaaactggccataaacaaaatctctgcagcactgtgacatgttcatgatggccataaagcttatgctggaaggttgtgggtttaccccacaatgagggcaaggaacacctggcccgcccagggcagaaaactgcttaaaggcattcttaagccataaacaatagcgtgagtgatctttgccttaaggacatgctcctgctgcagttaactagcccaacctgttcctttaattcggcccatcccttcatttcccataagggatacttttagttaatctaatatctatagaaacaatgctaatgactggcttgctgttaataaatacgtgggtaaatctctgtttggggctctcagctctgaaggctgtgagacccctgatttcccacttcacacatctatatttctgtgtgtgtgtgtgtgtctttaattcctctagcgctgctgggttagggtctcccctaccgagctggtctcagcaagtggctccattcatggggactcaaatccaggtcaaagggttgtcagagcaatagtgggaacagaaaactagctggaggacacccgagtactcttaaagcaatccccgtggtgagtaggaaggggagctcagaagcatcagggtaacaatgggacaggtgtggggtctggttcatttcaccttggatctttttcacactgatgatgaggaggaacgagagtacagtgaagtaatagaagaggttacagagcatgtttatttgccagctaaagctaaagtggcaaaggagggagaggtgcatccctacccttctgcaccccctcattattattttgaagaaaaagaccctccagatctttcttttccagaggacactgggcaaaaagtagttgtcccagtgactgtttaagcagcgcctcgagtgactgctcttagctctattcaggcaggaattcagcaagctagatgagagggttatttacaggcttggcagttccctgttagaatacaccccccagatcaaaagggaaatattatagctacatttgagccttttccttttaaattactcaaagaatttaaacaagctataaatcagtatggaccaggttctccttttgtaatgggactgttaaagaatgttgctgtttccagtcggatgattcctactgactgggacgctcttacttgagcttgtctaactcctgctccattcttacaattaaagtataaaaacaaacaaacaaacaaaaaacaaaaacaaaaacaaaaaaacttggtggggagatgaagcttccattcaggctgcttgcaatgcccaggcccaacctcaaattaatgtaactgcagaccaactttttggggttggtggatgggctggtttagatgcacaactggtcatacaggatgatgccatagaacagcttagaggagtgtgcattagagcttgggaaaaaatcacttcaggtggagaacaatacccttcctttagtgctataaaacagggaccaaaagaaccatacattgattttatagctcggttacaggagtctcttaaaaagatgattgcagattcggctgctcaggatatagtgttgcagttattagctttcgacaatgctaatcccgattgccaggctgctctgcgacctatcagagggaaagcacatttagttgattgtatcaaggcctgtgatgatattggaggtaatctgcataaagctactctgctagtacaggccatggcaggactgagagtggataagggaaatactccatttcctggagcttgttttaactgtgggaagcatggtcatactaaaaaagaatgtagaaaaattctgcgagtcaggccaccagataggggaaaaaaaagaaaactgttgagcctgaaatatgtccaaaatgtaaaaaaggaaaacactgggctagtcagtgtcactctaagtttgataaagatgggaacccgatttcgggaaatgccacgaggggcctgtcccgggccccattctaaactggggcatttccagctcaggccattccctcacccctgtacaatgtctgtcccccaccacagccagtagtgccgcagtagatttatgctgcacaaaagctgtgagccttctgcctggggaacccccgcaaaagatcccaacaggagtctgtggatccttgccagcagggacaataggattacttttaggaaagtctactttaagtttaaaaggcatacaaatacatacaggagtcattgattcagattataatggggaaattcaaattgttatatctacttctgttccctggaaagcagagccaggagagcgcatagcacagctcctgactgtgcaatgtgtgggaataggaaaaagtgaaattaaatgaacaagaggatttggaagcacaaataaacaaggcaaagcagcttattgggtaaatcaaattactgataaacgtcttacctgtgacataactatgcagggaaagaaatttaaaggtttggtagatacaggagtggacatttcaatcatttctctacagcactggccatccgcgtggccaattcaacctgctcaatttaacatagttggaattggtaaagcccctgaagtgggatcaaagtagttatattttgcattgcgaagggcccgatgggcaatctgggactattcaaccaattataacttctgtacctacaaatttatggggaagagatttattacaacaatggggagcacaagttctaattccagaacaattatatagccctcaaagtcaacatacaatgcatgaaatggggtatgtccctgttatgggactagaaaaaatttgcaaggtttaaaaagttcctgccaaagattaggatatcatttttgatggcagccattgttaagcctccagaacctatacctttaaaatggttagcagataagctaatttggatagagcaatggccgctaagtaaagagaaactggaggctttaggtattagttactgaacaatcagaaaatgggcacatagctccaacattttccccttggaattctccagtttttgtaattaagaaaaaaatcaggtaaatggagaatgttaactgacctaagagccatcagttcagttatacaacctatgggagtattacagccaggattgccttctcctgctataattccaaaaaattggcctttaatagtcatagatttaaaagactgtttctttactacccctttagctgagcaaaattgtaaatggtttgcatttacaattcctgcagtaaacaacctgcagcctgctaagcgttttcattgttttacagatgggtctagtaatggtaaagcttcttattttggctcaaaaagtaaagttttccagacatcctatacttcagctcaaaaagcagagcttgtagcggtaattgaggtattgactgcttttgatatgcctattaatgtgatttctgattcttcatacatggtttattccacacagttaattgaaaatgctcagttacgatttcatacagatgaacaactgatgactttatttacccaattgcaaacagcatttaggagtacaatgcatcctttttacatcactcacattagggctcatacacctcttccaggacctttgactgaagggaatcaaatggccgatcgcctagttgctaatgcaatatctaatgctagacactttcacaatttaacccatgttaatgcctctggtctcaaacgcagatacaacattacctggaaagaagctaaagctattatccagtgatgcccaacttgccaaatggtacattcctcatcttttacaggaggagttaatcctcaaggattggaacctaactgtctttggcaaatggatgtcacacatgttccttcatttgggagactagcttatgtacatgtatgtgtggacaccttttctcactttgtctgggctacatgccaaacaggagagtcttctgccagtgttaaacatcaccttttgcagtgttttgcggtgaagggcattccagcttctattaaaacagatgatgccccaggttatgctagccaagccctagctacatttttctctatgtagaatattaaacacattactggtatcccatacaattctcaaggaccagccatagtagaaagaatgaatctctccctaaaacagcagttgcaacagcagaaaaggggagacagagagtatgggaccccacagatacaactgaacctagcattattaactttaaattttttgagcctgcccaaaggatagatgttatcagcagctgaacagcatctacagaaaccagctgcaaagacagaagcagaacaactgatttggtggagagatctgattacaaaaacttaggaaataggtaaaataataacttggggtagaggttatgcttgtatttctccaggcaaaaatcaacagctgatttggataccaccaagacacctgaaaccttattatgagccagatgccaaggaagagattccgggaggatcccgagtactccccggttgcagccatgtcaagactgatgctgaggaggaccccaactgtcacaaacaacacatgtcaaacacagccactcatctggggacagatcaagaagctgccacagatggcggaagaaaacctgaggaaagtgggacaaccagtcacaacaagtaatttaatggtagctatgatagcagttatcaccgctgctgtgagtattccttcaataaggactgacacagagaacgattatacttattgggtatatttatcaatcttggctggcaacaatgcctggatgcaatcactctatgtcacagttacacatgctttctgatctcagtatttaccataataaatctgctcctataattgaggcataccgccctcaaaaacctatttgtaaacaggattggacccagttagaaaaaatgaacgtacttgtttaggaagattgcattgcagaacaggcagaggtgctgcacaacaattcctatggaatcattattaactggtcccctaaggggatgtttagcttgaattgctcctctcagtccgcgtcccacggtcatgctatgttcagataatctgaacaaaacggtcagatggtagaaataatagaagtatggcaagagttcctattatctggaaccatgtcggtatagtggcacctcaacctcaaatgatatggcccactctaggagcttaacataaggatttgtggaaactattaaatgcacttaatgagatcaaaatttggaaaagaataaaaaagcatctagaaggacactctacaaacttgtctttggatattgcaaaattaaagaacaaatatttaaagtatcccaggcacacctgaccttaatgccaggaactggagtccttaaaggagctgcagacagattagcagccagtaacccaataaaaacacttggaagctctgtgatttcaatgatgattgtgcttttaatctatgttgtttgtctttatgtagtctgcagatgtggatcctgactcctgcaagaagtagctcaccatgacaaagctgcccttgcttttattgatttgcaaatcaaataagggggacatgttgggagcaagccccccaaaatctggccataaactggccccaaaactggccataaacaaaatctctgcagcactgtgacatgttcatgatggccataaagcttatgctggaaggttgtgggtttacctcacaatgagggcaaggaacacctggcccgcccagggcagaaaactgcttaaaggcattcttaagccacaaacaatagcatgagtgatctgtgccttaaggacatgctcctgctgcagttaactagcccaacctgttcctttaattcggcccatcccttcatttcccataaaggatacttttagttaatttaatatctatagaaacaatgctaatgactggcttgctgttaataaatatgtgggtaaatctctgttcggggctctcagctctgaaggctgtgagacccctgatctcccagttcacacctctgtatttctgtgtgtgtgtctttaattcctctagtgccgctgagttagggtatccctaaccaagctggtttcgacatttagggaacctggtcatggctgggtatggcatgaccatgagctttgaaggggtgtaaaaacctagcacttattcttacctcttttgggtctttgaacctatatttatggtaatgctggctagtgttaacagatacattatctgtgttctatcatggtatatgtatatgtcccatccacatcaagttaaattggtgaagaggtctgcatctagttactaagcatcccaggctgccatgggattttatgatttttaggatgtggattccaagggtgctctgtgtgtgaatattcacccaccagatgaagaaagagaaggatagataacctcataggagttttataggctaagctgaaagagatctgcattaatggcctaaattttattaacgagaactggaagcacctaattgctaaggaaggtgagggatgtaatctacccgtgtgcctaagaagaaagggagctagatttcaggaatgcttagcagcctttgccgtagacctcattgagaaaggaaagaaagaccctatatccacccactacccatccccccaaaatatacaaacagcaagacatatgagaaaaatgctggtcattttggagttttacatcatccttcaagccacagtccctaggataaaaaccactgatattccagtttcttagagaaaaggatcagatcctaagtgatggatatttgccaacatcatttgaaagcctctttagccataagcagtacttagttgcagagactgagaattcatctttgggaagataagggagggaattgctactggcatcacctacatatggctgccacctgctcagcatctccagggcttacccagggatatcattgctataaggatacttgaaaaggtgaaaacaactttggaactggataacaggcagaggttggaagagtttggagagctcagaagacatgaagatgagagaaagtttggaacttcttagagactcgttaaatgattgtgaccaaaatgctgaaagtgatatggacagtggagtccaggctgatgaggtctcagatggaaatgaggaacttactggggactagagcaaatgtcacgtgttatgccatagcaaataacttggctataaagtgcccttgctctaggaatctttgtaagtttgaactttatattggtgagttaggttatctggcagaagaaatttctaagtagcaaagtgttcaagacttgacctggctgcttctaacaacttatgctcatatgtgggagtgaatgaatgatctaaagttggaacttaaaagggaagcagagcacaaaagtttggaagatttgaagcctggacatgtggcagagaaagaaaaagatttttcaggagaggaattcaagcaggctgtggagcaaccacttggtagataaatttccataactaacagggagccaagtatggatagccaagacaagggaaaaagacactgaaggcatttcagagaccttcagtgaagccattcccaacacaggcagagaggcctcttggaaggaagaagggtttcatgggtttggtccagggccctgctgccctgtgcagccttgggacattgttccccacatccaggctgttctagctccagccttgtctcagaggacccctggtactgctctggccactgtttcagaaggcacaagccaaaagcctggaagctcccatgtgtcgttaagcctatgagtgcacagagtgcaagaatgagtgaggcttgggaacttctgcctagatttcagaggatgtatgggaaagcctgagtgcccaggcaaaagcctactacagaaaacctcgcaaaaaacctctaccagggcagtgtggagggggaaatgtagggttagaacccccacacaaagtccccactggggcactgcctggtggagctgtgggaagggagtcactgacctccagaccccagaatggtagatacactggtagcttgcaccctacacatgaaaaagctgcaggcactaagcaacccgtgagagcagtcaaccggagtggagctgtccagggctttgggaatgcaccccttgtacctctgtgctgtgcatgtgggaaatgtagtcaaagagcttattttggaactttaagatttaatgattgccctgttggattttgaacttgtgtggggcctgtagcccctttctttttgacctatgtctcccttttggaatgggaatatttacctagtgattatacttgcatgataaaatatcctaggagtcaaataacttgtttttgattttagaggttcatagatggaaaggacttgcctcatctcaaatgagactttggacttttgagttaatgctggaatgagttaagactttggaggactgttgagaaggcataattatactttgcaatgtaagaaggacatgagatttgggaggggccagggatggaataatataatgtgaatatttgttaccacccaaatctcattatggaattataatcctagtgatggtggggcctggtgggagatgtttggataatgggggaaggtccctcatggtttggtgctgtctttgtgatagtgagttctcatgagatcgaataatttcaaatgtgtggcccctcccctgtctctctctctctctcccccaccccccacttgctcctgcttttttcatgtgacttgcgtgctccctcatcatcttttgccacaactgtaagtttcctgaggccttccaagaaattgagcagatgccagcgctatgcttcctgtaaagcctacaaaactgtgagccaattaaacctctttttttaaataaattactcagtctctcgtatttctttatattgtagtaatgcaaaaatggcctaacacttttatgttttcacttcatttgtgtagttaattggttgtaaggtaagcatgtagtttaatttacaggaaaatatccaaatattttccaaagcaggcatataatttctcatcccagtaatcaaaacgtaagttctagtaactgtatctttgccaagatttagtattgtctttcttctcctgcctccatattctcagaggtatgtagtggtatctcattatggttttaatttgcattatcctaatgattaataatatagagcatcattgcacacttacttgccatttgcatatcatcgttggttaaatatcagcctaaatcttttgctcacttaaaaatttgttatctttttaaagagttctttatatattctggatacaagtaccttattagattaatgtgtttgaaagtatcttctcctattttgtggcttgtttttcattattgtaacagggtcttatgaagagcagaagttcttatttttaattaaagtcctatttatcattttttccttttaatggctgtgcttttagtgttgtatctaaaatgtctttgcctaactcaatatcacaaagattatctcctatttttttcctagaagttctatgagtagaggttttaggtttacatctataatatattctcaattaattttttgccggtggtgcaaagtatggattacaatttatatatttttggatatgatgcaatttttccatgggtgcgttacctttttcattttgttagttttgtacctttgtttaaaaacatcaattgtcaatatatgtatgggtcttggtctgacttacttgtgatccattaatttatgagtatattatttcattgataatacaatgtcctggttattgtagctttatagtaagtcttaaaattagcctgtatgagtactgcaattttgaccttttttctaaaattattttggttattatattctctttgcattaccatgtaaattttagaatcatcttgtcaatttttacaaaataccttgctgtgattttgattgagattgtactgaatataaagattgtgagatgggcaattgacatcttaataccactgagtcatccagtctattaacataataggtctcatttatataggtattctttgacttctttggtcagtattttgtagtttccagtgtacagatcttgtatatattttgtcagctttaacctcaattttttatgttttagggacattttttcttttttcaactttaatttctaattttaattcccaaatgttcatcgctgcaatacagaaacataattgatttttgtacatttaatttgaccatgaaaacttgctaaactcatttattagttttggtatgttttatgtagcatatttgggattttctgagtagacaaacatactgtctgaaaatatgacagttttatctgtttcttaccaaaatttatagtttctattttttcttgtgctctagtgtgaatttgaataggagtggagaaagcatgcatccttgtcttttgcctaattttagtggaaaaactataggtatttgtagcctctctaaattatgttgagaaggtttccatttggttttagtttgctgagttaaaaaaaatcaattatagattttgaatatgtggaaaactttttcctgcttatattaagaaactcatattgttttccttatttaatctgttcatataataaatttcatcatttctgtgatgagccttactcggttgttttgtattatctcctttttatattgccagattctacgtgtaatttttttgaggatttttaaatgtatgttcacaagaaatgtttttctgtgattttcctttcttagaatgcttttgtatggctttggtagtattagggtaatgctggcctcataaaatgaattggggagtgttatctccacttctattttctaaaagagatttgtggaattggcattatttattctttaagtgtttgatagaattttccagtgaaatcatctggtcctaaagttttctttcttggaagatttatagttattaattaattatttcaattgatttaggactattcagtttatctatttctcctggaatgaactttagtagtttgtatcttttaacgaattttaccatttcatttatttatagacataagttgtttttaatattcccacattattttatatgtagaatttatactgatatcccttttatattccttatatttgtcttttgcatcttctctttttttgtttttatttaacttctggccagaaatttatcgattttattgactttcgcacagtcagcttttggtttaattaattttctttattgtttttggtttgcaattgcattagtttctgctcttatatagtcagtaaaaatttaataaaattttatttccactgatttatattcttttgcttttttcaacactgatttacattaaaaactccaagcacactataactgaggggaacttccttgacataatgcatctacaaaaatgctaaagccaatattatacttaatggtgaaaaattgggtgcttcctccaatttctcaagaagtcaagaagtaggcaaggatatcctttctcaccattcctattcaatgtgatactcaaaattctagctagtgcaataagataagaaaaggaaataagtatccgcagattggaaatgaaaacataaaatggtttgaagatgacatggttgtctgtacagaaaatccaaaggatttgacaaataaactcctggaacagataaatgattatagtgaggttttaggatataaggcatattagtttctagggcttctttaacaaattaccacaaactgcatggctaaaaaaaacagaaatttgttttcctattattgtgaaggctaggagcctgaaatcaaggtgttggcagtgctgtgttctctccaaacacttcaaagaagattccttctttgactcttcctagcttcttgtggttacaaacaattcttgacactccttgatttatagatgcatctctccattttttgcctccagtcttcacatgatgctcttctctggtgtgactgtttcttcacctggctttcttataacaggtaccagtaattggatgtacagctcatcctaatccagtgtgaacacatcgtaacttaactaattacatctgaaaatacctattttcaaataaggtgacatccacaggtaccagggctaggacttgaacatatctttttgaagaaattcacagtaggactccccaaattcatgtccttctcatgtgcaaaatacactcaccctgtcccaacatctcccaaagtcctaacccatttcaacatcaattcaaagtccaaaatctcataaaatattctcaactaaaaatgttccaaatctcaccatgaaaatcatccacatttggtatgatctgagtatgatccatcctggggcactattcttttttatctgtgggcctgtgaaactggaaaacaagccatttcatttcaaatacagtagtgagagagacacatgatagacattcccatttcaaaggaagacattggaagaaataaaggggtcacaagtttcaaggaagtccaaagcctattagaaaaaaatctattagactgtaaagttggagaatcattttctttgactttattctgtgtcctataggctgagggcaggtagagctcttttcttagcagccggggaagcaactccatcctctaggctctgggcttccagagactgttggcaccagctccactcttttggcccccagctagataaaagtagccagtctgaaaagcctacatagtatataatgctaattatacaacattctggaaaatataagattatagaggctgtaaagggatcaaggaaaagggagaaataaatatgtgaagcataggaaaattttagggcaaagaaattattatttataatcctgcaataaggcctgttttcaaaattgatagaattttacagcacaaagaaagaaccttaatatatgcaatttaaaaattatttagtaagttggaggattccacaaagaaatgcagactatggctagagaatctaactgtactacaaaagcaggaggctgataaattattcatttttgtaactttagaaatgagtggagttggtaagactaacggcaaatgtagctgcacataagcattgtactctagttcatagaggtctttcccacacgggtatgtcttagcaattctagtactgccatacatcttaatactgctatacttaatagtggaactagtaagtaataagtggaagatgatggagccaggtttctgactgttggagtggaaatttacagattagaaagggaaggaggctagaataatctatgtgataatggattagcattagaaacaacagtaatatagaatagatgattttatatatataaattattcatagatacgtgtatatacaccatttacacacacacacacacccctacacctttttctctgtcagctgatagagcctaagaaaagtaacacctcagtggcaatgagctcccaagcacctaaatcttgatttctaataccattccctgctctctgccctaaaaaaaaaacaccaaaattctttggaaaaatggctgattctagaactgagacagggaatatacaagatgagcctggagcaacttgtaatgccagaaactggaagtactcaacgaacaagcaaacaaaccccacattgatgggagtatgcaacaaacaaacaaacaaacacaaaaaacaaataaacaacaagacaaaacacagaagctaactgaaagagctaccaatggtcaatgctaaagcaaattgagaaaaaaagaagttgtattagattctaacccaaagtataaaataagtatctgagtctatactgatatgaatacgtggttgagtaaattattgagtaaataaatgcaggagaatagacaaatctctcatgtagaagaatcccaaataattcacatagatactccaccctctggaaagtgaagggcttgaatgcttaaaaatccatacattgaaatccgaacccccagtacttcaaaatgtgaattgatttgaagatagggtttttacagaggcaatcaagttaaaatgaggtcattagtgtgggtcctaatctgaaatgaccagtaccttataagaagaagaaattttaacacagacatagacaaaaaagaagacaatctgaagacacagggagaagaagataatctacaagtcaaggagagaagcctgtagcaggcatttcccttacatctctcagagggaaacaaccctgctgtcagcttgatcttttagcttccagaactgtgaggaaaaacattctgttaagtcacccagtctgtggtcctttgtaaaagcagctttagcacaggaatgcaaggtggaagatctgggtggaatttattttctttctgacaacagtggatccttcctttactggcaaggcctgtgctacaaaggatggtttctggagtatcctgcctgcctcattctttcctgttaacatgcagtaaggcctttgcaaaataccccatgagtcagtgcaaactgccttcatgtatactgctcatatataccagttttctgtactctcatactagttctcagttttgagcagttacttgttaaaaattttagcaatttgttgaaaaaaattagcttcttaccccgcttgtatggcagccctgttttcctcacatgctctgtcccagaaaaaaaaaatgacatgttttatctctccttggaggcacctgaaatttcaaactagttgattgctctgtgaccccagatctttgatatattcaggaaaaaatcataattatgtaaagtatccaatttttttttttggtttgtaaactgggagcaatcctcttttcataacctaagaagaagccagaaatgtctgcatttcaacaaccattagagatttcgttcttccaagaatgcctttcttctaatctgtttcctggtgtaaagtacccagcttttaatagatgcttaattaacaatttataatattagcattcttatgcttatcacctatgatgtctccccaacatgtctggggccagggcatgaattccacaaggaaatcattgacttccagatcaatgacatcttttccagaaatctgcattacagccatgaagttcatgccaacagagctcctgggaagacatacccattggccacattttaagagccagcaaacacattatttgccaagcacacaaacccactataactgatgagggtgatggtttggagcatgagctataacgttggggagatgtggttagtcttgacccctacctctgcctcttgtgaattacatgacctcagacaaatcctgtaaccccctgtgctcagtttctttataaaattgtgctgataatgatggtatccaacccctatgcctggctcatcataggtgattcagagctactagctatttatttagtcattttatcttaaaatcttggcacattgttgcctggatgtcattgtctccagtgcatggagtggccagacccctggccctgccttttctctttttccctgggcagatggagctggttttcctttctggcacacactccacagaggaacttgggaaaggaacaaagactgaagaacaaatcagcctattttccactttttaaaagtagctctgtcagaaggttgagtggaggaggagtttgcagccattggctaaagagggggttctctttcctgtctgtagctttccattcattctcctgtccattacaccacgctggccttgctagtccagggacatcggccccccccacctccagtggtctctcccctgtgtcaatgactcagtttttgcctagagttcccacagctctagggaagagaggtgaggctggagtaaggcaaagccagaggggagcctgaccctgggggcgggggttggtggggcagaggggggcgtcctgcagttgcagttgatgagtgagttcttggtcctgacaggacagatgaggccctttgttcctgcaaatgggcctttcctggcagtgatggagatcgcctgcagtccagcccgctcctcctcttcagctgcagccattatcctaaagtggttttattgatctgctgactccctgtctcctgcctgctctccctttcctcctcccttccccaccccctgcaccccatcctcaagctcctaaatgctctgttgctggcctcatccatgcaaggctgttttttcaggggtgaaggatgattttgaagttagattagacaactgcacttgcctcatgagaaagcagatattcccttagggcaagcattttcagactagcaaaggatatacctccatttaccaaccacaccttttctggatgtagttctttggttgttttgactttttgtaagatgtaggaaatatagatgctatgaaagttcagtttcaaagtttgcaccttggcaaactatagtacattttacaatgtcatgataatgccgcattttaaacaattaccagtcatattcatcttaatacaatttacatgtaattaaagaaatttttaaatcatttagcatttttgcttaagacttagttataagctccataaagttatgtattcttattttatttataacaaccctgtaagataactgtcataatccttatttacaggtgtagaaaaataaatgacttgaaagtcgtaaatctaacaaataccatagacaggactcaaagctaagcccattggacataaaaacttctttgtatttatatgaaagtctgtatttttgatgctgcttaaaatgttaggcacacatctgattaaaaagctgtgctctattacaggtgtgttatgttcgatattacccatgaaactctagcagtcttcattgttaaagagggagtgacccaggtgttaaattacctgagagctggcccatgatcgtcatactatgagcatagtcatacatgctcaggagaatttttaactgagatgtccccatttagctctcgtgtggcttttacagttgtttaaaacattttgagagaatttggagctggtgttcctcaataaaaacatgaaacctggaaagtaatttaagcctctacccaaagttcatgaataaaacttactaagaatctttcttggctaggtgtggtggcttacgctggtaatcccagcactttgggagggattacctgaggtcaggagttcgagaccagccttgccaacatggtgaaaccccatttctactaaaagtacaaaaattagcccggcatgatggtaggcgcctgtaatcccagctacttgggaggctgaggcaggagaattgcttgaacccgggaggcagaggttgcagtgagccaagactgtgccattgcactccagcctggacaacaagagcaaaactcagtctcaaaaacaaacaaaaaaacaatcaaaaacaaaagaaaacaacaacaaacccaaaaacaaaaacactttcctcctagtgagatatgggaccagaacacagatgtggaaacccatgggttcttatacctgaacacttggtgtcagcgtaggtcagtagcaacaatacagagttaagaggcaccagaaaccaagatgctgtcatgacctttaattaaacttacgatcatcttatgtgcctgtatgaaaggcacatttaggagagatgtatgtaccttccatgggcctagaatgaattactgccttgttagaataagagtgaggggaggtctctggaagaatcagattctggttattagtggaggcagtagaatagagcatcagtgagacaatccctatacataattattatttattactattgaacaatactatctgctgtgcaccaatccggttcactgccatatataacattgacatgctcttggccctgccaaatcaataccttctgttgcagactatagagatgacttttgtcctttatctgcccccacaccccattttcaaagtgggagatgtttagaacaagatataattttcactatctctattttaaggctagcacctggagatgctccttgctgtacagtaaagtgtgactgtattttgttttccattgacttacattataaaattggtaatgtgttttcattagaaaaagaatatcataattttaattgaatatttgatatggaaaagtgagtggagaggaatgagagcatgtaggactgggaatgaggatgcctgggattcagttctaaaactgtcactgcataactaggaaactgggcttttgtcatgattttgcctctgtgaaagctgggatgagtccgaaagctttgagcctcagtttcttcatctgtataatgacaggctggggctaaatcagggacatcaaatatgtatcacatatactgtcacttgtgatttctatgcctatagcagacattactaatcaaaagcagttttctttctgataaagccaaaatacagtcccaggccacccataaatgagggcaatgttctgataagagttaaaacctaaaatgcttgaattctatgctcacgcaggtcctttccagcccagacaccccagatcctgaattagtggtcagcctcctgcagttttatgccaggagcttcccatatattaaactaatctttcaaaaaactccctcaattcatttcaaagaggaaagtcatggatacatttcagaaagaaggttatttatgcaagacaaaaatattattatgaaaaaactgaattgttttttctaaagcaaacttcagccaatgctgcacttgttttggatctattcaattttggtctccttttcctttctgtcttgagcagctctcacattctctttctccctggactttcatgaatttattcctaataaaaatttataattgtggcactacctacgttcttgtcactttgggggcttgttggccatataccttgtacaaataatctctatcatttattgcttcttcagagaagatgttatacatgtgcagacacataaatgcaaagtgaaaagaagcagtcagtagatgataccaagcatcaattcttctgttatattattctgaaactgaatacagaatagctgggtatctctattgaatgtttaactgtgaatttatttttttgttattgtaaaaatatttgttaagtatacacaaataaataattcttttatgatgttatcttgcaagaacatgcattttaaatgaaattgacctgtgacttatttttttttatgattttttttattatactataagttttagggtacatgtgcacattgtgccggttagttacatatgtatacatgtgccatgctggtgcactgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtagtgggatggctgggtcaaacggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttgtaggttgcctgtttactctgatggtagtttcttttgctgtgcagaagctctttagttaaattagatcccatttgtcaattttgtcttttgttgccattgcttttggtgttttagacatgaagtccttgcccatgcctatgtcctgaatggtaatgcctagattttcttctagggtttttatggttttaggtctaatgtttaagtctttaatccatcttgaattgatttttgtataaggtgtaaggaaaggatccagtttcagctttctacatatggctagccagttttcccagcaccatttattaaatagggactcttttccccattgcttgtttttctcaggtttgtcaaagatcagatagttgtagatatgcggcgttatttctgagggctctgttctgttccattgatctatatctctgttttggtaccagtaccatgctgttttgattactgtagccttgtagtatagtttgaagtcaggtagtgtgatgcctccagctttgttcttttggcttaggatggacttggcgatgcgggctcttttttggttccatatgaactttaaagtagttttttccaattctgtgaagaaagtcattggtagcttgatggggatggcattgaatctgtaaattaccttgggcagtatggccattttcacgatattgagtcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgattttggtacattgattttgtatcctgagactttgctgaagttgcttatcagcttaaggagattttgggctgagacaatggggtttctctcaccactcctattcaacatagcgttggaagttctggccggggcaattaggcaggagaaggaaataaacggtattcaattaggaaaagaggaagtcaaattgtccctgtttgcagatgacatgattgtatatctagaaaaccccattgacctgtgacttctaatgtgatcacatgattgtcaggctgaaagttttatcagttggttttcacttttaaggagtttctgtatttcacattatatttcttcagttacttaaaatgaaaaatgctggtattctcatcagaggctgaattttgagtgactattgggtagaaactttaactgaaagcatgaactttttattttataaaatgtacgtaccgccccctagaagacacaagtttgatttatagttaaggttatttcagatcaggataacctggtgtgaacatagcacccattgccttatagggagggtgggtcctctggaggaaaaatcgtctttccaaatggaaagatgaatgaatgaataaatgatcctcttaattgtaaatgagaggcagcatggtttaacacacagaatctaagactgtgctaatacaggcttgcatcacaatttcaactctgatacttactactaatgtgtgaccttgagagtctgaccttcagactccttaaactctgtaaaaatgttctagaaaagcatttctagagtctatgcataattaatctccctaaatatgtcacaaaagacagaaaacaaaagaaaataaattggctggttttattatgtattaaagagttaaacattttcttgctaaaacaatcattaataaaattaaaatatgcaaatactgtgtcacaaggtagcttcatcctataaagtacctttttacaactctaagaaaaagttctatcccttcataggaaagggcatgaagtatttcctttaacaaatatttttgcaatgtttagagaaggggtgagggatttttagccttctctcctgacattattacctacgaggataagagacagagaacatttctcttcctgtttctctacctctggctatacccctgtcaccagctctgccataagtattgaggagacaataatttgatttatgagaccatgctttatgaatggggaagatgactattagttataggtcaggaccctcagaagccctttcccccctgcattctggctcctggtaataagcagagtcatggcaggtacagggatcttccatccttctctagttcccaggtcttttcatccttcagtgaacccacataatgataatgccaggggtgcctcttgggagctgattgactaaggtgacttttagcaaaaatgaagaaagaatacagtacaagctatattcatcaacccagattctccaagggaatcttgcattttgtgtgtctggaagagaaaggtggtaattgtatgtgtgtctggatactaataaagaagaatctttccagaacctctcacttctgtcagggtcaagctccagcaagtgggtgttatccctcagataccactctcttgtcctaactcaggtaagaagaacccatctcctatgggtgaagtgaagccatgaatccatgaaaatcacagactggaacaaagtcctctaagggatgttcttttgactttctaaccctattcccatatctccagtaacatccctctaaatttggagacatatatggggttctcagaattttcttgcacttatttcctgaaatatgctgccaggtttttgagtaggaatggtttgaaaacctccaaagctctcctttaattttgccaaaatgtgatgtatttggtagaaaataaccggagcttattatgtacattctgggctacatcattgtctaggtttttataaatgtgccatgtatacaagagtatatatagagtcaccatatatacaaagagctttttaaatttaagtttgttgagaacaaacacatcagttgtctaaaaaaaaatcttctattgtgctgctgttgttgttgttgttgttgagacagtgtcttgctctgtcgcccaggctggagtgcagtggcatggtgtcaattcactgcaagctttgcctcctgggttcaagtgatactccttcctcaccctcctgagcatctgggattacacgcacccaccaacagcccaactaatctttgtatttttttagtagagacagggtttcaccatgttggccaggctggtctcaaactcctgatctcaagtgatccacccgccgtggcctcccaaagtgctgggattacaggcttgagccactgcacccagcctctactgtgcttttcctacttgaattttaaacatatcccaaaagttatgtggggaagtgaataagttatctacatagtccttgattaggtttgatcagcattagcaacatttcccaacgctgtcatggagacccaaatcacattgatatcaagctacacaccctgaagtgggaaggtggccagaaatggagactttatctaatgtcagtttgcatagactttattaatcaccattaataagaaatgtcaagggacagctgttggagaatagagaatccttcatgtaaggaaacgaatacactgaagacaatcagcattctgggcctttgccaccaaaggttcaccaggaaccttagggatttgagatcattaaaggctgtatctaggtcatgctcctctcttcccaccaggctggcataatccgcaggaacctgaacgtgcatctctagcctatgcacttaggacagtgattcctgctgtcctggcaagttgctgcagctctgaccatggagaagagggtgagaggcaatgcagaccccagccaaatggaggacttgcatttttatagtcactgcccttcatatactgaaaatgaaaatgtataatttctcatgatgaatccctagggtaaaaccaagaagtatttaattatatcaactaccagcaatgattctttcttcatgagaatttagaagtcagagattccaaagggtcttccctaacaataagattgatgccttctgccccctcctcaggcttagttttggcttccataggaccttgcattcctcgccctgtaaaaactggaagaaactctacagggccacttgatccattctctgaggctgaggacctcatcaggctccattcaataggctttttgatgacccagatttcaaatgccccatgacaggaaattctcactgttatatttgtgctttcctgttggacctagtggattttgttttcatattattatttaatttacagacaggaaaatcattggagcctggagttgtcttgataacactgttaatgcaattgccaggacttccctgtgtatgctgcccaaaccctggaacactgaattgctgtgatcgttgtaaggttccaggtgttcatttcaagggtgatcacatgacattccataatcacacttatgaaaggactaattaaaaatacagatgtcttcagctcaaaatacccagacagctgaaatacttattagttttttttatgttaaactccatatcctcacttctttccaacagaaaaactaataatagataacaaagcacagacagggagggccttcagccttttttctcccattaattgacaggctttgtttataaataaaacacctagtacttttacaaattggtattttaccataatacctttttagattactttgttttccctttcagaatggctcagccacaatattgtttgtctagggctagaggatttttataagtttgtagtccaactcttctaatatagaggtgatagtcatacaaaagatcttacgtgtccaagaacatagaaccattaacggtctttcagccttaaaaagaaggtgccttgtaatgcaaatgtcaagttgtctttattctacctgggaggtagaataaacaaaacaattattatattcaaaaacgttttagagatgtgtggacctaagaactttggcatgatgaatgaaaagctctttacagacacattgggtttgcttatgtgaaccagagcaaatgcatttcccctgactggcagataaataattaagatccaaatgtatagttaaaaataatgttaaaaacacaaaatttatgttttatcaagataatatatatttaaggtgcaaagtcaccctgcaaatgctggcatgacgttttattaatttctctcttcattcattcattccttcacatatacacaatcacaatatttgtagggcttgctaggtaagaggcactgtgtgagacactgggtataagtgtacagatatgaacaaaagttgtactggagtaagtcacacattttcaagagtcataatctgtgttcagtttggaaaatgtaccagagacagtaaatctagagatcagaaggtcaacaaaactagagtttggaaggttgagaacataacccaggctttgtatcaccctttatttcaaccctagagaagataataacacatctttgggaaagaaagctgtcaatcttctaattatctaaatcccttggaatgaaagtgaggaaaaggcaaggctggagagaagtggcatcgacctttcccctcacatggattttcctttctgacttctgcattactgtcttcagctctcatgaaaatagcatgataattattgtctgctctcccctatttcattttatttattccagaaatttttttgaggatccactaaggcaggggtccccataccttaggccatggactggtacttgtccatggcctgttaagaaccaggccacacagcaggaggtgagcaacaggcaaacaagcattacagtaatgctcagtaattactgcctactgtcagataagtggcaacattagattctctcacaggagtgtgagccctattgtgaactgtacatgcaagtgatctgggtgacacactcctcatgagagcctaatagtgatgatctgacgtagaagagtttcatcctgaaaccattcccccacccacacccctggtctatggaaaaattatcttccatgaaacaggtccctggtgccaaaacggctggggactgctgcactaaagtatacaggtattttcctaaccattagggatttatcatggatggggcagctgtggcacccagcctcatactgcttgtaaaccctgaaaaaccaaagggttctactctagggttctaatgccaatggcaacaattggctttggaagaagagaaaaaaccttctaattcctcttttaatgtattcattgacccatttgtttttcagggctatgttgtttagtttctatgtatttaaaaggtttctgaggttcctcctgttactgatttatagttttacactattgtggtcagaaaaaaaatgcttgatattattttgatcatcttaaatttgttaagatttgttttgtggcccaacatatgatctatcctggagaatgttccatgtgtggttgagaaaaatgtgtattctgcaactgttggatgaaatgttttgtaaatgtctgttaggttcatttggtctacagtgcagtttaaatctgatgtttctatgttgactttctgtttagatgatctgtccattgctgaaagtggggtgttgaagtttcctgctactgttgtattgcagtctatccctttccttagacttttaaatatttgcttcatatatttggaagctgcaatgttgggtgtatgtatatttacaattgttatgccctcttgctgaattgacccctttattattatatagtaacctcctttgtctctttttacaatttttgacttaaagtctgttttatctaatgtaggtatagctactccttctgtcttctggtttccatttgcatggaatacctttttctatcccttcacttttacttcatgtgtgtacttacacgttgaaatgagtctcttattggcagcatatagttgggttttctttttatccattcagccactctatcccttttaattgaataatttaatctatttacattcaaggtaattattgataggtatttactattgccgtttttctaattgttttctagctgttttgtatatattttcttccttttttccttagtgtcttcctttgtcattaagtgatttcctttagtagcacgttttgattctttgctctttatttttagtgtctctactataggtttttgccatgtggttgttatgaggcttacaaaagcattttatagttgtaacaggttattttaaatgtgtgacaacttaactttattaataaaaaaaagactgtacattttaactctactaccctccctgcctcattgtgaatttttgagtcacaatttacaacattttatattgcatatttcttaatcaattattgtagttattattttttaatagttttgacttttaaccttcatactagggatacaaatagtttacaaaccatgattagaatatgagagtattatagatttgattatatatttacttttacttcaaatgttttgtgttattcattagcattcagtttttcagtttgaagaaatccctttagagtttcttgtaaaacaggaatagtggtgatgaacattcacagcttttgttcttctaaaggatagttttattgggtatagcattcttagtcagcagttattttttcctttagcattttgaatatattttccccctcccttgtggcctttaagatttctgctgagaagtctgctgctaggtatattgaaactcttttatatgtaatttgtgtcatttttcttgctgctttcaggattctttctttgtgtttgacttctgacagtttgataacaatatgtcttgggttatagtcttacttgaattgaatctaattgctgactttaactttcctgtacctagatatgtatatctttcactaagtttggaaatttttctattccttcatctttctattttctcttgaactccattgacctgagcatttgctattttgatgtcaccccttaaatcctataagcttactttggtcttttcaatttatttctcctctaactgtacattttcagatagcttgtcttcaagctcactgattctttccactgcttgataattctgctgttggtgctttctattacatttttcattttattcattctgttttttacatccaggattcctgctttatttaaaaaaaaatctcaatctctatgttaaatttctctgatgaatttctaaatttttctcttattttcttgaagttctctaagcttccttcaaatagcatttttaaattttttgtcagagaggtcatcatcttcatttctttagggtcagtcactaacatcttattttatccattaggcagtgtcatttttctctacttgttcttaatccttatggttatatatcagtgtctatgcattgaatatgcaggtatttatttcagtcttttcagtttgattttttatgtgactgttctgcagtaggcctatctagaaattcggagaaaactgtctcttttggtcttttctaaaccaatgactgctgcacttgttgcagtgctagaagcacttggtttgctgtggctggcaccaaggtttgctgtggctggcaccaaggtttgtgttttggttgctgtgagctccacccctcttctttgtttctaattgacccctaatagactaagcctgctaacactcacaatggttctcataaaatgagaccaaagcaagcctcctataaagggttccagaatggagaggatgccaaaattccacctctaatacaccttttccattgtaaaaaccataaattcagaggaagtttcttcatgtcgtactgtacaggcttgggagagggacatagcggtcaaaaaggacagttacttttactgtctaattatggtttttctctgctctgtgctcaaagtcaatattacagctttgctcctgagttcttaaatattcagggtggtaatcttgcctctggatagatgctagttgggtttccatggaaggagaaatgtcagaaaactcctacttcaccattttactgatattacttcatcaggaccttctaattttgattttacttttcaatctttattttttctaaaactttttgtttcctcatttttcaagtattaaattatcctagttgttctagtagaaagcactgtcttatgtgtgaacagtgacagataaattagatattctcagaatattcaatgatggcaactagaaataatcctggctcaatatcagtttacaaatttgattgttttctctatgttctgaatttttttttttttttttgagatagagtctcactctatcacccaggctggagtgcagtggcgtaatcttggcttgctacaacctctgcctcttgggttcaaacgattctcctgcctcagcctcccgagtagttgggactacaggtgtgcgccaccatgcctggctaatttttgtgtttttagtagaaatggggtttcaccatatcagccaggatggtgtcgatctcctgacctcatgatccactgcctcagcctcccaaagtgctgggattacaggcgtgagccactgcacccagcccattctgaaatttttgtgttctactttctaagtcagtagacattcattattcactatgataactactattacatgtggctattgagcacttgaaatgtggccagtccaaactgaaaggtactgcaagtataaaatgtgtaccagatttcaagaattttatattaaaaagaatgcaaaggccagtcgcagtggctcacgcctgtaatcccagcactttgggaggccgaggagggtggatcatgaggtcaggagttcgagaccagcctggccaatatggtgaaccccgtctctactaaaaatacaaaaagtagcctggcgtggtggtgtacacctgtaatcccagctactcaggaggctgaggcaggagaatcgcttgaatctaagaggcagaggttgccgtgagccaagatcgcaccactgcactccagcctgggtgatagagcgagattgcatctcaaaaaaaaaaaagcaaaatattatgttaatacctttatattgattatatgttaaaataataatatgttggatatattgtgttatgtaaaatacattattaaaattaatttcacctgtttctttttccttttcaaaatgtagttaccaggacatcttaaattgcaaagaggctctcattacatttccataggccagcactgcacttctcccttgccactcttcattaacacatgaggtatcattctcaactatatttgctaataatttactctcctcccttctcctggcaatatttaaaatattactgagtgttttccaggtcctgtctattgtgattgtgctggacatgtaataatgaagaaagccaaataagtcccctgctttcacatgacttctgttttataggcaaccccaatgacattagggtggtcacccctgcccacgcacttagtttcagtcattactggactaaagcaattgagaagaagtacaacccattctaatatgagttgcactattaatagttcacagttgatcatatgtcttgttacttgttatctaagtgtctacagcatctccagtacaatgcttctcagagtttgtagaatatgtgtggctttggaaattcagaggtgttctgaaaacaaagaaacagaaagcacgtctgtgatcaaagacatttggggaattctgggttaaatgaaacacaacatgcctctttactgcaggactcgtcaaagcttttgcttttccaatgcagtattatgaaactctaaaagcaggatatcatgaaagtttttaaacgcatttgaccaagaattctgattctggtgagatgtttttcctgggaataaaattgtggacaataaaattttggagatggtgttcagttcatttcttcatcatccctcattttgacatatgctgtcctaggctggttctacagcagctacctctcaagtgttcatatccacactggtcttgtttgtgctttgtgtttctgggactagagctctaaaaccatatttctactctactacctggctccacctaggttctgctagttgaggaagactagaagaaggctttctgcttcctgtttctttctgcctcttgttcttttaacgatgtcctaagcaacggctaacagtactcaccctaacagtagtagttctttcctgtctcagcagctgaatccagctgggttttttaaaatgacacttacagaactagtgccataacccccgtcccccaatcagcatgggccagtttagacccctcctcagttgtttgagcctcagctccaaggtgtcccttctgtaagggtctaagtattcataattaaaatctctttcgtttgttcacacagctgtggggtggtagctatttactacaggtgctacttttggataccacagggtgttatctttgtcatttcagttcctcaacacagctctttatattaaattttctgttaaaagaatacatgcagttctttctgactcctgattatacctgtccaatatactccattcattctccccactccctaggccaacaatctgagtggtaaagcagaaagtgatttgaatgagatcatataaaggattccagcattatctcagtcactgtttctgggctaaactgagctgtctctgttctcagctctcagagtgagctcttctcagtcgctaggaagttaaggcctaagaagacgagcctccatggaacagacctaccaccagcctacccctgctggcttttcctggtttgtttagtcatgaatacattgatctgaatttgtcacatttattcttctcacttggaatcttgtatctactaccttgacaaaatcatggaaagagaccatgaccacatttttattatctgattgtcttcctggaaataaagagttgcgactgtcactggctggcaactataattgttaaacctaactgaagaattgaagtctactacattcaggagtgtttggatcctagaccctgattttggctttcaattcatgtctttctgcactggcacatttttgcatatgtatacatgttcatgtgttgtaggtccttctgtgtccatatatgcacacttgcatgtacaggaacaggtgccactgtgtaggcatgtgtgtgatgtgtgcatgtgtgaatatgtgtgtgtgtgaatgtgcttaggatagacaagaccattttcatacacaagactattttcaccactatatctctagtatctcacatagggtctgtgctaatggatactcaaacatagttattgaatgaatgaatggatgcatgaaagaatgagtgttaatgctaacacaaaaaggaatgaaatctgttcatttctttatttaaggtgggcccatctagatcagctctatttaatagacatataatgcaagtcacataagtaattttaaattttctagtaaccacattgaggaaaataaaaagaaatagaataaattaattttaaaaatatttttatataatcaatatgtccaaagcgtcattatttcagaataatgaatataaaataaataccaatgagatatttgcatttttaaaagcctttgaaattcagtatatattttactctcatagcacatctaagttaggagtagccacatttcatggactcaatagtcccatgtggctcaaaattgcagttttagtcagtttaagtcttgttaatatcctttggacaatggaggaatggaggatattttctattttctattcttcaaagtttagaataaggagtctttggaatccaggatactttctggattggagaaacgttggttgagaatgtgaatctctgataacccttaattgctgcaaaagttacatggttcagctcacatgtctttctctgtcctcccactccagtgttctggaggggaaccaaactagggccctattctgaaacctgttttcctttcctaaaatctgagcccctttgctggaaatgtgtctctctctctggaacctgatcccattccggaaacctgtatctttttctggaactggctacaactatctctttcctcttcaagctcagccatgaagaaattttttaaaaataaagaatacaaacacacactaataacaagaaagcatgtgttatcttctctctcgtatcctgcatcttcaatgtctttgtattagatcagatattgctcaaaatacaggagcctgaaatttctacccaccctttttttttgagccagaaattccctagattcacaatgtcatcatccacccctatcaataccccattttatggctgtgacggtggtagaaattcacatggccttagtggaaagccctgtgtctccccttccccctgcctcatcttctctgttattaggtacaacagaatctcagagatggctccattggcttcagaccttctgcccattacattacatacaatgtctttttaaattttctaaaatggagtaatttttaacaagcgggtggtggggagtacttcccatatttttcattaacgtatactgttaactatgccagtaaattatggataatttaatttaatttaggcttaatggcaacatttttcctcactaatgaaatggttatttgttattaggaaaatatttattgaagtggaattgtgtgatctctcacatcattattaaaccttgttaaaccattttttaatttcaatttgggtttaattaagagtcattaagcattttattgaatctaaattaaattctaatggaaatgggatttgccaaagagacagttgtgccctttcttcactctcagttctctcaaagtgacatagttacaaaaggacttggggtgaagtggaactccaatattattgataaaatggaaagaacaaaggctttgtttcagattgatcatagttctaataccagaactgcttctgacataccatgagaccttgggcaagtcatatcatttttgtgataatcaccttactcttctgtaagatgaggactgtaatagagtgtctgtggaaacaaaaggacaaaaattatataccaaatggatattttaagcttctttttttgtctgaggtatctacaattccttaggaaatggaatttaaaaaaaaaaagtttgttgaaggaaaaaaaaaaaaggaaaccgatgtgactaaaaaaatgccaatgtacatcgagttgtctatctgaagcctgaattcccaaagaggatgtaactggagcaaagacaagggagtaaattagagtttaatgagcctgaacttggaaaaggctagaccaagaagacaggagcacaggtcaactgtgatgagtcttgtccacctgaaaacacatgggaggcttcccccctgggtttggaccttatgaaacatttggttaacgtgaagcctgcatgacatggatagatctttcttggcccaatatagtggaattcaaaagtaaatcctagtcctatgtagattccttgaaagggataaatatcaatattcattctttcaacagattacctccatggatctcctatatgccaagtcatattagggatatggcagccaacaagctcagacaaatcctcttgggaactttgtgacataatggtagagaaacacatggcaacaacacaccacaaaataacaagtggtataatgagaatatgaataatgtgctctgttaagaggattgtctgatgtgccaattattgaatattgactctgcatgacttaccagcatgtcatccctctaagagtctcttctctgaattctactttggatattcaccaaagtcttaactcaactcttgaattcaatctcacctgtagctcctggaaaaaaaatgtcattttttcctgaatgacccaccagttggataagtctctaattttacctgctcaggagagctgctggagtatacctcttcaaaaagaaacattcatccttgacatgactttcacttcttctggaattagttctttagaaatatgtacaggtctttatttttgatgtatctcaaccttagatggaatcttttgccatcttgatatctgaagacagttttcaacacatacctaaacccagggaggctttttacctcccagtacttttctttgctttttatatattcaataattaaaaccagaggaaaacttatacaggccaaagagagcaagggggcagcccctgaatggttcctgcattaacactaaatatatttattttcatcagcctaacacatactcatgtgcacatgtgcatatgtatgtgagtacagaggtatgtgcacatgcatgcagactcagttgcataacttccatctacacttccagatcaattctacatccacttttactctgttctgcgatccagaagtctgacaagtgtggccaacctcaatgagtcctctcaacttttggcttctggttggggtcagcagaaaaattcagagagaaagaagagtgaagggaattaatgtgttctgtcatctcccttcctatgaggtatcatgcgtggcttcatgtgttgaccaagattacagcttctgccatatgactgtttttctccaggggactgctctctgtcctcatcccttcaggtctagggcagtcacagagttctggtattgctatccccagaacactacactgtggtgtgcccttatggttactctgcaacctgcttatgcctttgtaaatagttgctttactaaacacttttgaagttgccaagtttgattgtgctatctgctttctaccatgaccctgatttatagatgtacacagaagcactcagatcaaaggtctcattcaatgttgaactagactgccttttcagggggctggtaacattgcctattggccagtcaaggtgtctctaactgtgtttctagtcaatctgagatataataaaagtgctggaaagatcagcagacttgatccattccttcaccatgtctttctgctcccaggagaaggtcaagctctgtaagtttccatctaatggcttcttttgtcttcattccagcaaaggagaggactgagtggcccagatggaaagcagaaatgcagacagaggcctgtggaagaagaatcttaaaataactaagcaactccaagaaaacaagtgaggatttattggaaacaactgccttgaaagaagaaaaaaacactccaacttggtaagaaagatgagaggacataaaaacaagtcagattagaatcaccataagaaaattaaaaagaaagaaagaaaaaaagaaaggggatagtccaaaaaaaaaaaaaaaaaaaaagtccagagagcaaaagtccaggatacctgggcctctgtcttccttttaccagctacggggtgatctaaacttatatatctgagcactcactggcactgaaaaaaaaaatcacagaagtagagtgaggagtaaggaagacgacctagaacatcttttcactggtgtgaattgacagaaaaatcaggccattacttcaaggagtgggatgatgactttatggggatatcacctaagtacagcctgacgccccatgctaccctcactcccaagaccagccaagaaagatggatcaggaagccaggtcaacagttccatctttgatacttactagctataagactgaagaagttgtccgatatctttgtctcagttttttttatatgaaaaatgacagacaattcatgaggttgttgtgaagactaaaagaaagattaaaagtattgcattgttatctcgtataaaattaagacttaaaaaaataatttccctctctccatctctttctttcttttcttcccctttacttccttcatttttccctgccatccttctcctctcaatctgatgttaaagctctatacagatattcgttattttgctattgttgttgttgttgttgatactattattatttttgataccactattattttgttgtgcagttttgttttgttttgttttttgagatggggttttcctctgtcactcaggctggagtgcagtggcacaatctcggctcactgtagcctccgcctccagggttccagggcttctctttcctcagtctcctgggtagctgggattacaggcacacgctagcacatgccaccatacctggctaatttttgtatttttagtagagatggggtttcacaatgttggccaggctgttctcgatctcctgacctcaggtggcctgcctacctcggcctcccaaagtgctgggattacagacgggagtcactgcacctggcctgttgtgcagttttatttaccctgggttttttttttgtttttttttttaacagatattagcctctcttcagccttttccaccccatctggaatcttacaacgaactgttgggttttaacacagtgttttgtcctatttttaaaccaaattcattagaaaccaagaaaaagaagagaaaaaatcaacagtagtatttcccaaagttaaggcttaattttattttgtgtttgttagttatgggtgttcttgctagtcaatttttccaagttagagctcaggtggaattttattgccaatctgcctattgataacaaagaccatctttttgagcactcaatattgaggtggcatttccccttctagcttacagaatcaggcaatggatgaagcagttctggaaaggcttccttccgccaacttggacacattttttctttttccagcccagatgaacttcctcatttctccgctctgatgataagccctgtttaggctcgtgctttcatctgcctgggtggcatcagaattcgggggacatgtgacctcagctcttgtgtttggatggcatgtggctatgagactctgctaaagtaaacaagttttatataatagacaatgatgacaataaagatagtaatataaaaacaagttgtacagggcatctactctgctgtgctagagactctggagagatgatgtctatttctcagaaccatggtggttagggaccgttatcccatttcttaaagaaagaggcccagggggctgcaaatctttacccaaagtcatgcacccacagctagtgagaggcaaagccaagattttctttacattttgtgatctttttctctctcagtgaaaatatttgcggcggtatttttctccttaccacatattaagcaccattaaaattaagcacattaagcaagtttgcacaagaagagagagaagaggaaaatgcaaaggtaaccaggggagtagaatgttctctggccttgctgggactgtccactccagtagaaacgaaagggagtcctacaggagatgatgcagctcaggtgccttctaaggtacattcctgccacccaccttgcaaggcagaggcttaaactctcgtctttttgctccattcatatccacaatgcctcttaagatcctctggagcctttcttacagacaatattttgtcctttccagaccttgcttggtgaaaatcacgttagaagtggtaagtagaaagatgaagacttccagctccttctgttactcttcccaccacttctgttctgaaaagctagacttgctcaggttttagctgtcatcactgctcatctcatttcaaattttaatggtagtgacaagtactttcttttcttccccctctacttgtgctttcctgtttctcagtatccattcaaatccctgccaagactagaaagattcacagcctttatctcactgtctagcagagtttgaacatatctcactgcagatatggggtgaaaggtatgttattattgagactgtgatgcaatgcatcccccaaaattgtttgtcattcatttaacaaatattcactgagtcataaagtgattaaaaattcaggctctagaatcagattggctgaatatgcagtacagccctgacattgtttaaactatgtaaatcttgagtaagttactaaagcttcctaagccttatttacctcttctgtaaaatggggataataacgggtaggtgttactaggattaaatgcgtgtcaagcacttggcatgtttgcccagcatagattttgtgaagtcagagataccttgatctcggcaagaactgtgtctatatgtatctgaaggaagaggggagaaactggagtttctatgtggctccagctctgcatggctcctcctacctactgatgtggccttgaccaggccctattctctctgagcctcagtcttctcttgtcatgggataagactttcataactacacgaaatattcaaaactaatcttaaatcagtgtaactgttcaataaaatgatatcttgcactctatattcctgttttattaacctatcagtgaggcagatctaggggcctttatctgggttttaaagaagctactaggaattttcttggctacagtcagggacattgttcaaagactgtgtatgtgcaggggcagtgggtgcagagtcattaggcactcattggcttttctgagaaaaatgagctcaggaaaaccaaaatcttggccacttttccattctaacacctcatctttctctaaggttaagctaacctggtgagcagttcctagcctggaataggcccctctgccacagtcagctttagggaaatgagaaaaacagtcaaaataatgcagcccacgtgacactcatgccagcttcacccagggaaggagtggaacttaagctctccagcccctccaggtatcagcccgaaagttaacattaaatacaggactgtgagtctgaatgagtccactgtggaaggttctctaaaggtcgaagagatctatttgattcatttaaataaattaaaaaactttttggaataactttagatttgtataaaggtctcaaagctagtccagaattcctggtatatttcttctagcttttcctgatgtgaacatattatatattatggtatatttgccagaactataaaatcaacactggtaaattactaactaacctccagactttatttgggtttcaccaatttttccatgattgttcttttttgttcaaggatttaatctagtatacttcactgaacatagtctatgcatgacttttaatgtgctgattggttttgtgctgctatagagacatatttctgggtgatctacaaagaaaagaggtttatttggttcacaggtctgcagactgtaagaagcccaacacctccatctgcttcctgtgagggccttaggaaggttccaatcatggcagaagggaatggggagccaacatgtcacaatgtgagagagagagagagcaagaaagagaaagaagaggaaggtgtcatgctctttttagcaatcagatctttcaggaactaatggaataaaaactcactcattaccatgagaacttcgtcaagccattcatgaagaatccacccctatgacccaaacacctcctgctcggccccacttctaacataggacatcaagtttcctcatgagatttggagggggcaaatatctgaactacatcaaatatgtcagtatttgctttccgatgtagacagttctgtgtgtactaaaagagtctacaatttgagctctgatttaagcatctttccttctagagaaatccattccttgtatgtttatcttagtcatatcccaaggaagtggtcaggatgctcagattttacttaatacccttatgagaaattattttgactttttactcctccactaggtggttaaacagtgaatttccttgtttgaagaatgcattgattatgtgccaggcagtgtgctagatgcttatacagattacctaatttaattatcctaatgttcctttgtgggaagtagtagtattattactgttatccagacaaaaagactgggttccagagagatttatcacttgcccaaataaagtggaagaaccagaatttaaagcagtcttgtaactttgaagacaatttgctcctctgatgtttccattttaaggcctctgttttgcagagctctagctctagagcaagaaaaaacctacggtttctcttacaggctgcaaagagatggtgttcacctctgtgtgcttcaagatatggtttacatagctaatgtacagtgctcttagtcagcattagttcaagattaaatgtttcagagcctaaagagtaagatgtcagtgattcctgatggatctaaaatagcaagtaaatcgtgcagtggttcaaatgctggataaaagagcttatctgcagctgggcacggtggctcacgcctgcaatcctaacactttgagaaactgaaatgggtgaattgtttgagcccaggagtttgagaccagcctgggcaacatggcaaaaccccatctctacaaaaaaaaaaaaaatacaaaaaaattatctgggcttggtggctcatgactgtagtcccagctacttgggaggctgagatggcaggatcgcctgagctcagggatgtcgaggctgcagtgagctgagatcatgccactgaacttcagcatgggtgacacagcgagatcctctctcaaaaggaaaaaaaaaaaagcttatctgcattatctcccagctctcctcacaacgtatatacttaacagaagcttggcattttactcctgaatgcccaggatactatgcatacatttccctccctgctggtaggtgtttctctgggaagaggaaaaccacagcactttgccgaggaagattagaatcagcgtggggaaaattctgaattgggcgcagagggctccgactgagtgtgggatagggggattcaaggacaaggacggaccaggaaggtcatgcattcaggcctgagacccgtttcatcaaccttgggtacagggtgtgtgcgcatataactacacataaatccagattaaggagagacagacaaattttccaacacttgtaggcacaaatcagttcatttatttattcatctatagaacaagcatttattgagtacttttgatgagctaggctctgtgtccacagatttctcatcttagtctgcttctcaaagctttattaggccttccatgggtgcagctatatgccagcctcaggaaacctatctttctgaaaaatacatttttttttctttcaaaggaaaggagaagctagtttctgagggacacaagaaaatcaaagaaaccagagcaaagtgcaggatgccatattcctaatagcaggaagaaaacagggtcctgttgtaccttagtgaccccgaattcctcagggtggagcaaatgcagaagggctccagggccatctgcatctgtgattttcattattgcatcctctctgtctcttccgtcctgtatataccagtaattaaactgacaatgagaaatgcacatctaggtgtcaggatagagtgagtggggccatggtggacattgtgggaagggacagaatggatgtgctctgccatgagtggaccaccatcactaaaatggacagttgttgtaccaaaaaagaaccatagacagagaccatagacagaaaggacacatactcctttgggaaatatgtactgcagcaaagaagggtcacttattgctataaattttcctctacgtactgctttagtagtatctcacaaatgcaaattttaatgtattgttttccttttcatttagttcaaagtactttattttgatttcacctttgacccagaacttatctagaggtatgttatttgtgttcagatatttctgtttttcattttaatttgattttaccatggtcaaagaacatattttttacaactttaaaattttagcccgggcaccgtggctcacgcctgtaatcccaacactttgggaggctgaagtgggtggatcatgaggtcaggtgttcaagaccagccagatcaacatgatgaaaccctgtctgtactaaaaatataaaaattagccgggcgtggtggcgtgtacctgtaatcctagctactcaggattgtgtgaggcaggaggctgaggcaggagaattgcttgaacctgggaggcggaggttgcagtgagctgagatcgtgccattgtactccagcctgggcaacagagggagacttcatctcaaaaaaaaaaaaattgaaaatgtgttaatttaataatttgaagacttgtttcatgggccagaatatggtttatcttggtaaatattctgtgttcacttgaaaagcatttgtattgtattgttaggtggaatgttctctaaacatcaatttagtcaagtagtttattgtgtattattcacttttctttgcatttactgattttctgtcaacctctttatcagttattgagaaagaggtattgaaatctctaggtttccacctgtaattgctgatttgtctatttcttcttgttatttagtcagttcttttttattttttttctttttttccagagataaagtctcactctatcacccaggctggagtgcagtgatgcaacctggcctcactgcaacatcagcctccctggttcaagtgattctcttgcctcagcctctggagtagctgggattacagacttaatccaccatgcccagctaattttgtaattttagtagagacagggtttcaccatgttggccaggctggtttcgaactcctgacctcaagtgatccacccacctcagcctcccaaagttctgggattacaggtgtgagccactgcatccagcctatttagtcagtttctgatttttgtgtttgaagctttgtttttgggcatgtgatatgatttggctgtgtccccacccaaatctcaacttcaattgtatctcccagaattcccacctgttgtgggagggacccaggaggaggtaattgaatcatgggggctggtctttcccatggtattctcatgatagtgaataattctcacgagatctaatgggtttatcaggagtttctgcttttgcttcttcctcattttctcttgctattaccatgtaagaagtgcctttcacctcctacatgattctgaggcctccacagccatgtggaaccataagtccaattaaacctctttttcttcccagtctcaggtacgtctttgccagctgcgtaaaaacagactaatatagcatgtaaatgtttgggattgttatgtctcttatgaatttacatctttatcattataaaacaatttttttctatccttggtaaaatttcttgctctgaaatttagtctgatattaatataatcattacagaattttttaaaaatggactttattgttttagaacactttttatacttacagaaaatttgagaagataatacagaaagctcatatacttcaagctatgggatgaattgtgttcaacaaagaaggtatgttgaagttttaacctcctcaaaatatgacttcatttgaaaacagtgtaattgtaaacaactattctaagtttattttcaaatgacactaaaccacttcaaggataatgcaggtatcttaaacagagtattgtcagttcttccctccagttccttataaaatggttgtcattcatttcatttgtctatatgctataattattcaatacatattactatttttcttcttaacaaattgttaactactggatcaattaagaatataaaaaatgaaagatttaattttgtcttcattccttcttcctggatgcttttcttttctaaggtaaatccaaaattctgacctatcatttttcttctctttcaagaactgcttttaatatttcttgcacagaaggtctgtgactaaatttcctgtttttgtatgtttaagaaagtctttatttcttcttcattttttattttaaatcaggtaaaatttatataacataaaattaaccattttaaaatgaactgttcaatggcatttagtacactcacaatgttgtacaactatcacctctattcagttcaaaaatttcaccctaaaagaaaatgctgtgcttattcagctgttgcatctcatttctctatctttctaagccctaaaaactaccaattggggtctgtctctatggatttactacatcacatattttatataaatggaattatacaatatataatcttttttgcctgtgcttcctttggtagacataatattgttaaggcacacccatattgtagcatgtatcagtgcttcatttcttttcctggttaaataatattttattgtatgtacatattataatttgcccatttattcatttatgggcgtttgggttactcccaccttttgactattgcaaatagtgctgatcttaatatgtgtgtacagtgtacatgtgtttgtttgagtatgtttttaatttttttgatatatacctatgagtggaacttttgaataatgtggaaaacctatgtttaacttgttgaagaacttcaccctaacatttgaaaataaatttcacttgatatagaattcttggttgttctcttactttttatttggcacttttaatatttcattgtattttcttcttgcttgcatagtttctgataagaaatctgctgtaattttcatccttattccttgaggtaacatgtttcttttcctctggaagtgctcaagattttctccttgtgtttggttttctgcagtttgaatttgatatatttgagtgtagatttttggcattgttcttgcttggtactctgtgctttctatatctgaggttttgtacctgtcaataatttggggaatttcttagccattattcaaatagttattctgtttcattatcccttttattctggcacaccaataacacatatgtcacaccttttggaatgccccactgttcttggctattttgtacttttatttatttttcattcttttttcgtttcattttgagaagtttctattgacatgaatttaagctcttctgattttttttacttgattttgtctaatctactgatgagtctattcttcacttctgttatagtgcttttgtttcctgtttgatctttcttagaatttccaactctgtacttgctcacattacccatctgttcttacatgttgtctactttttcccttaaagcatttaacatattaattatttaaaattatctgcctgataattacaaaatctatgttatatttgattctgattctgatgcttgtctcttcaattttttttttgccttttagcatgccatgtatacttttgttgaaaattaaacatgacttattgagtaataggaactaaggtaaaagggcttttgtgtacattgctatggaaactgagctaggcattggctctgtttaatgttttctttatctatgcgtattaaagatttcaatttcctctggtgtccttgatttttttttccttttttgtgtttgagttttcctaaaaactcctttttaatagtctgtgccttgcagttcttttaactgtaattcactgttattatatgaaagctttgatgacagggtggtaaggtatacactttctataatgctatgattaagcctcagtcttttagtgggcttctgtctctgatctgtgaccatcctaagtgtatctcagtgttttttcccatattaggtaagacatgaagggtagagggtggagaatggagacatttcccttactgcacagtggatatggctttagtaaagtcttttctcttgccaagtagacttgtcttatggagaatgctctgggcatatttcaaagtggttactttatccttccttctgccataaatgtaaggcttttctcttgcctctttactgtgagaaatgggtaggttttctgttgttttcaggaggtaaaaacccaaggaacagtagaggcttccctaagagtgtggtttctaggaattcttcactctccagctacttcacactaagactccagcaatttattaaaattatgatttaagcattactatcagctaatggctccagctacttctgctccaagtaagctagtcatggctgcagaaccatgcagtttcttatctttctagatttcttggtggtactttgccctgtgacctcaattctctgatggactcagaaaaagtcatgatttttggtttgttcaggttttttttttcttattgtacgaatagaagtgataaccttcaagacctttacatgtcagagctaaaagccagtatttatttcactggtgttagtataatatatcctttcccatcatttaacttttagtctatttgcatctttatattccaatatttttataggtaacatttagttaggttttgttattttatccaatctgacaatctcagccttttaatttgagagtttaggtcatttacatttaatatatttattaatatggttcagtttaaatctattctctttctctttggtttctgtctgactaatttcttctcctgtttttttcttctaccctctgtttaattaattgagtactttctgcgattccattttatattctttagctcttgtctattattacattttactggttgctttaaagtttatagtttacaatatatattcttaacttactacagtttaccttcaagtgatattatatactttgtatgcattataagaaccttaaaatagtatacttctatttctatttcatttctctgggcttttttatttttattttattttattctattttattttacttttgagacagagtttcactctgtctccagggctgaagtacagtggcatgatctcagctcactgcaacctctgcctcccaggttcaagcaattctcctgcctcagcctcccaagtagctgagattacaggtacccaccactacacccagctatttttttgtatttttagtagagacggggtttcaccatgttggtaaggctggtcttgaactcctgaccttgtgattcacccgcctcggcctaccaaagtgctgggaatacaggagtgggccactgattcttttctgggcttttttgttactgtggtaataccttttagttttatatatgttataaagtatgcatcacatatttattattttgtttaaacagccaattgcatcttgaaggatttaaacaataagaacaaaatcttacatatttgtccacagacttaatatttcttgtgctatttatttgtttaaaacatgtgtattaggcagaagaatagtcttttacctccatgatgtcaatgtcataatttgcagaccctttgaatattttaacatatataatgaaagagattttgcagatgtgatcaaagttaaggaccttgtaataggagcttatcctggattattcagaaggccctcacttaatcacttaattctctaaaaggaaagaacctttcctggctgaagtcagaggctgaggtcagaggaagacgtgactatagaagaatgatcataggattgcaatattgctggtcttgaagacagaggaaggatgtgggttacatctagaaactggaaaaggtaaggaaacagattccccttcagtaccttcaaaaagaaacacaactttgccaatatcttgatttttagcctagtgctctctgtgtcagtcttatgatctatagaactatacgataataaatttgtttttttaagccaccaagtttgtggtaacttgttagagtagcaatagaaaactaatacatgatgtatcatcagtgagaataccatcacccccaagaggatgaaattggttcttggatgccaacatacttttttatgtataaatattactttttgtgtgtaaatcatgaatatgcatgcagtacataaatagatatacagtgtatctgtggcattaaaactttatgacttagtacttagggaaaaaagtctaaaaagactccttaggggatgataataagaaacacttgagaaacactggttcagatgcatattttcatcgtcttattttccttcagcctgaagtatttcctttattgtgtcttgtggtgtaactttaccatctgtaggtggtaaattatttcagtgtttctatgtctgaaaaaaactttagtttgctttcatatttgaaaaatactcttgctgggtatagaattctacattgacagttttttaccccttttattactttaaaagattgttgcactgtcttttgtttttctggtttctgacataaagttcactgttatccctaaacttgctcttctgtgtttaacatgtcctttttctttgtctattttgaaagtttgtactcatcacttgttttgagaaatttggttatgctctgctttgggttagttttctatgtttggtgtttatagggcttttcaaatctacatatttatagttttaatctaacttggaaacatttgggcaactgtttcctcaatttttgttttcttctcctcttttgggtattccaatttagtgtatattagatctcttaaaatcgtcctatagatcactaatgcttttctccatttcttttttacttttttaaagtatttgattttgcatcatttctattaccatgtcttcaagtttactaatgtttcttccagttatatctaagctacatacatcatagatctttctctcaaacattttacattttaccaataatattttggtttatatttatatttgtcctgtctctacttaatttttaaacatatgagaaaaattatacatccaatgtccttgcttactaattttaatatctgtgctgatactgggaagttttaatttattgatttttttcttattattttagtttttgtttgcatacttggtaattcttgattgtgtaccagatattgtgaagtttgcatttttggatgtttgatgcttgcatgtgtgtgtgtgtgcatgttcttaacctttgttctgaataaggttacttgaaaactggttctctagaattttgtgttttaagatttgttaggggagaccagaacattgtttattctacgactaatctttctctagtactgaggcaagaacctatgctgagaaaaatatgagcatttctttgaattcattaagagagggtgttattattgatcagccgtgtcaatcatggagagcagatggaagaggtagcacatgtacccattatctgcattctatattatgtatattcgtgtaataaagaaccaagaatgattaccttggaattttcccaagatactgagatactccaagtaggggggcatcagggaagatgactgagattattactcacattttaaaataagtaaggtcgaagaggctaaatgactttttaaattcaatgagacttcaatgcaagaaccaggatttgaattccatttaaccccatttttaaatagccaatttaattggagagatggaagcaaaatgacagacaatgaaagtgatattggggcttcacaagactatttcactgtcccttaactacattatgtaagttgctgtgtcatctacccattctaggtgaggaccacacgtggaaaagggaggctgagaatgtaagacatcagcagagtgtggatctgatagctgtgttgggactaatggaagatagatggtttgagaggtaaggagatggctgggcactgctgggaatgttttgaaggcacatctgggctaaacagggagtatcatgaatgattagcagtatttgctttgagcttggtgaaatgaaggtaaaggagtgtaaataaaggccattatgttaacaacctaggcttcttttcacaagatcatgacaaagaccttggtggataaaatcttgctggttgtattacttttttgtttatttgcagttagttagtttgaaatttcctaggtgaaaccatttccccttattgcaaatatttttcatgggactattgatgtcattcttccactcccttgcagcaggatggacagataaccacagaacccaccaaaattcttctctggaaatgatgcatatatatatgcaggcacataaaaatatttatatagagatatatatcttttctatatataatacacatattttatagataaaaatattttatctatagaaatatacacttttctctctatatatttattaatatttaaattatatttatatgttagaatatatagagaaatatatatagaatatatatagagaaaatacatattttctattttctctatatattatttacatattatatatagaaaatatatatattatctatatatttctacatgtattctatatatttctgtatattatatataattatatattatatagaaatatatatcatatattaaaatacataatgtatattcaaatactttgtttttatatataaaatacttttatataacagtatttctataaaaataaatattttatatatttctatatatctatatttctatgtctagcatagaaatatatatattattaaaaatatgtaatatatatttttatagaaatactttgttttggtttgctgagctataaaaatatgtcgggggctaacagtgagcatctcttctagtttcatggtgaagatgatgatggtaaagggtctggactgagccacacttgaaagataacaaatatacttgagaatctcaattgagccattcctgaaactaacatgaacttccttgttatataggccaaacaattccattatgttcttaaaccagtatctcagtttggtttccccagaagcagaccttgagacaaggatttaagtgcaagttctttatcttagagataatactaggatataatagtatgaaagaagagaagcaaaacaaggaacagaagacagtcactaaaagtcttcttatccaggcagtaaccacaatacataattggagcgtaatctctttgggaaaccttaggagccagtataaaaatgtgtctgcagattatcccacctgtggagagaggggttgggggtatctatgtactatgccctttagtcagttattgagttgtgatcccaggagacatcaattcctggaagttctggctgccttgtgggtgggtggcagcatgggctcgtagaaccagaggaagccctcaggcaacgaaatgcagggctggccaatttaagttgggctagtgtggactgaggtgagggtgaagagacatgagtgtcgcaaaggcgaggtctgtcgcagcttcactgagttgaatttccatcacctgcaacagagagtgctgggagaattcagggcccctcatgtgctctcagacctgatccatgccaccatccagctttgtagagaaggcagcactgtttccctttcttgaaggatcaccctgccctctaggtggcatatgtgtgtaccccaagatctagacactgagaatggaactcggtagcctctctgcggagaaagacaaacccttatgaagatcagatgaggctttcattgcaggaggccttatactatttacccactgacaacttctttctcatgaaagtttgttttcagggttgtgccctgcctaatgtgatttgtttatttttcttgagtgagaaccagctttggcttttaggatttggcctcagttgtatttcccattagtcattttccctgcaataaatgttgttggctgtaaagttggagtccttttagcacaactgggaggggcttgaggctcccaaatattggcctttttctagaggaagcaaaaagaatagcatgaggtaaagaagagtgtctgaagtcagtaactattgttttgatatgcttagattttacccccacatcttattctttacccacccaaatctttgacactagaacatgagaaggaaaataaggcaggcaggcaggaagtgatggtggtacaaaattaggctggagtgatgggcaggaaccatctcccttagttctaagatcaacccaaggaaggtcatgtcctcaaggaaggatggatcattcccacattcaaactgtaaacaccatcatctcactttttataaaggctttcttatgagctcctgaagttgagcgttaactggtaaatgtgatcgtgtaccacattccccctcctctcttgccccagaccctgccaacactacaatcttcatcagatcacacccaatcagagaacacttagtgtagatactaagagttgggggtgcattgttcaaaatctctgatctttggtaaagttcactcattaagtctgtttttttaagcatctgatccattccagggaccgttttagacacctgcaataaagtgatgaaaaagaaagacagtctcagtcctcaagaaacttctgttctgattagataggcagaagacaaataagaaagacattaattcaatagttatgcaacatctctgtgccttagtttccaccaacatatgtgaaatggagtcaataaaaacacccactttgtgttgtaagagttagatgacctaagatggaatcgatggaagagaccctcgcttattcatcattgctccctgtgtatccattctctggtagaggctgaattctaaagattctggtcagcaaagccctaaatctgaacatgcttgaatcagatgaattctgcaagggactggcacagaatagggaacccttcttgtgctctggacacaaaccctaagccaggtgtacctggacatcattttctaggatgcacaaagggtcttcattcattaatgccttgcacatgtcagaagggaagagaggctttgggcctcagccttgccattcagacccagctccttactggtacaacccttccatatcccttacttccagggcctgggagcatggtctgcaatgcccaatcatgtctggatgtgcctccaggttcagacattactatccctgctttttctggttttcatttccttttcttgtgtgctaggcttttgaaatacatattgcagccacttgttgccctgttttctaagctgccttgaactgctgccagaggctgttgccagaggagctaatgactaagtcactctccttttggcctctggcaggactggaaatccacttggggatggggtagcaaaggcccagccatcctgaaccaatcaggaaaccacaataaaagtgccgaccagggagtcagtcactcaccctcaaagctcagcgctgagctcagcatggaggtgtccacgaggctggggatgctctagtttgcttctgcagaaccacatcagaagcagagactcaggcacaaaggcaggaccttcagagaagccttggggggtatcccagggtcagcaggaaagagaaactcactgtgtttctgagccaggaaagacagagaacagcaaagaaactccaggctgtgagccaaagacggcaaacccaggtgaagtagattatgaataacaataataaataatagttaacagctattttgaacttacttcatgtaaggccttatccaaacacttttaaagtcctacctcattcagttcttccaataaccctgtcagataggctctattatttttctcactttcagaataggaaactgagtcacagatttagtttgcagtggcccaatgttgtcccagtgattccctcttacaggacaattgcaatcctcttggttagtaatcctgatttcaaaatgcatttcccagttggtttatttgttcaggtgtatccagcacttgtactgagagctcaggatagagaagataagacagtcctggtctttgtctggctgattctgatggccacagcatctccagccacccattttgacctgttcttgttttcacctttgctttccattatttatgggggtttatagtacagtaaaccattaggttggtgcaaaagtcattgtggtttttgcctttaatttcaatgtcaaaaaccacaatgacttttgcagcaatctaatagtttctattttctgcccatctcctacaccttcatctctcttggatttgccatcacctagaatgtgcctcttccctatctaccaattttgctcttttgagttctgcctgtcctccaagtatcacctacagtttccaatgttgctgccttcattaagcttttcacaagaaccccaacctcaggtcttctctctctcctctgaactgaggggatgaacactttgcagcaagtttagagatttttacctcatacttccttgcattgtccatttcctttataactgaagagaaatggccgtatcttatcactctttcagtttcttccatatgctattatggagtagttaaaaatagcttatggattaaggaaataatttaacaaaaaggatatggtgggcagcttctaagagggcactatgatccccacctcctggtattcacgtcattatgtaaccttctccccttgagtgtgggcagaacctgtgactttcctctagccaatacaatacagcaatacttataggctgccacgtctatggttaggttatgtaaagttgtgaattccatcttgttagtagactctcactggctttgaagaagcaagcatccatgttgggaaggcctacctggcaaggaaatgagggcagactacagccaaggagaaactgaggctctcagccccacagccattaaagaactgagtttcgccatcaactccatgaggttagaagcagatccttcacagtgcagccttcagatgagacctcaaccctggctgacggtttcagttatactttgagacaccctgaaccagacagcccatgtaaactgtgccctcgttgctgacccacagaaattacaagatgataaatgcatgttgtgttagtccattatatttgtggtaatttggtacacagtgatggataatacaggaaggttcagcagacaaagcctttttggaagaattcaaatggattgaaaagtataactaaggaaagcaagagagtgaggtgacatttgaggctggggaagtgtgtgagcaatggctttatggaatgttcacaaaagagttccaggcagacctggagatgtagacaggaagctaactggggaggccttaaagcaaaaagaagaaaaaaaataccaagccagaagaaagaaaaatggtgacaatgtagagaaattgtgatagtgaggggatacctccatgaacattgagaatgagagaagacggagatgctccattcataccagatggcctttaccttcgtataaatgcaggttctcaggttatctgctgaaagcaagagaggaagagggctttttagtgtaacaatactattgatgacaataagtcaccattttacatctcacttaggcctcacagcctccttatgagaggttttatttccatctacactttgtagataaagattaaaacattcagagagattaagttacttgctaattgtcatccagttcagaagtggcagaatttggaaacaaactcagatcctagagccatggtgtcatactgaggttctggaacatttttctgcagatgctgtggggaacatgctctttgccagtgctgttttactgctctgtgtcaagagtgctttgggaacagtgacagaaaacatgatgggtttagactcagaaggaggaagtggtagaaaacatgatgggtttagattcaggaggagaaggtggtacaaaacataatgagtttcacctcaggaggaggaagtctagcaggagatagaaacaggcagaagagaggcttttttattgagaagacatgaagtaatctagtgtatcaaggtaaatttttcaggaggtggaagacaaccagtgtgtgaaggttgtagctactggagcatctgcacacaggaaaacacgagcttcccagagacttcagatcagaaagcctagctgagctgtgaaagaagacggaagatgagggactggctccaattataaagtaaatcatagagtaagatggtgaatggagatatgtaggtaagggatacaggaaacctgtccacttcattccaataaacattgatatacatgctcatagattaattgaatctttcactgtgattcccggacaaagcagtaccatctctgaaataaaagcctctattttctgtttccatctttatgagtcaagcagttgttatcatgtttttagaaaacaaatgtaggcttcaaattcgtagttactccggcctattcaatgaaaacaacaatcatatgtcaaaatgatacgatggcatgatggttcaggatggactgagttggcatgagagtttaccaaggaggatggaagcattttccaactttcagaaaaagagtgatggtgtgctcacctttttggcataatcctggggtattgagaaccagccctcatgcgatactgagaaaaccactaagaaggcagctatgacgtttctttcctatttttttctcaatgcctagctctgtgtttggtgcctaataggtgacttataaaagcatattgacagaatgaatgagtggggaataactttgtatgttgctttgctcagtccctttgcagtctattttagataaacatacattctagtgagtaccaggaattagacagcacatatgcagttcagagactgagggtctgagaagtccagactcctctcccagctctcctctccacttacagaggaaaccaacctcctcttctccccccacctcacagaagagggaggccagctctaatggccttggccccagtttgcttgtataattaatgtgggatttttcctcctctagtaaaaaatgaccttgtcaaacaagagacgacaaaatcttggttactgagcaactgtggactccctgctgggatggcatcctgggccttgcaaagagaaatctaataaaattggtgtcaggggctccctgggtgccagttcccctgctgcctgaccccacaatcccaatttattagccaaacccaagaaagcagacaaacctcactggctccagacaggagacttccaagtgggagctaatgtgggggctggggctaggcttcagcaaaaatgacaagggaaatgacaggaggtgccagccgaccagggagcctggggaagccttattcagagcatcatgctgccttgacagggccggtttcaacttggtagaagaatgtgttagaatggcccattgggaaaggaagtgttttttctctctttgtactgttatttgcagggccatggacagcatgtcttgcattagccatgttcctgggagtcagcaggcgtcagtagaggaatagccaaagaaaaatatttgcatgtggagttttcattttgtaaactgagcacttcttcaagtacaagagagttttaagtgtacagtcactatttacccttccacacaaccaaaactccctgcgataggaaacactgatttgcattgtacactagctgcactccttattaactaaatgatcttgggaaaatttcttaacttcttcacctataaaatgagataacagtactattctcataaggtgaggattcaaatatgagaaaaacagaataaacccacaaaacgatagcaagtcactataccagcaaaaatcagctagaaaaagaaagtctatttcaaatagcaatgagaactctaaaatgtctaggaattgtcttaacaaataatatataaagcctatgggggaaagtgtcaaaactctaataaaggacataaaaaaccatctgataattttaaagatattccatgcttatgaatgagatgtcttaatatttaaagttaccaattatcttcaaagtaaactatgaacttaatgcagtgacaacctaaatttcagacagatttaaaaatatctagagactagaaaaatgcacacaaatgtatatgatataaaaatataaaagcccataaataggtcaattttggaaaagaagaacaaaaaagagcaatgtactgcactaaatgttaagatatattacaaagtcatagaagtgaaaacagtatggcagtggcccccaaaatgaataaacacatcagtggaacagaaaggaacattctcagggagttatatgcatacctgagcaggtgatatatatatatatatatatatataaaagatgacaacaaaaataagtggataacattttatctgtaagttttaactgatggtgctgagaaatttgacttaccacgtggatgacaatggaaatccttttactacaaataaaagggtgtccagatggattaaagtccaaagtgtaaaacatgaaacttgaagtttaaacaaagaaaatattattaagattaggagcacagaaggatttcttaaaaaagtctcaaatatcacaaatcatatgttgtcaaagttaagaatccctgatcataaataccatagacatggttaataaacagttgacagattggcagaaattacttgcaagttatttgcaaattttaaaattagcaaaggacgaatatctataatgtataagaaacacccaaaagtcatagaaatagaatgaagggaaaatgtatgagtaggcaatacacagacaaggtagtcctagtgaccaataaataaataaaaagatactgaaactcattagtaaacagaaatatgagtggaaaaatgcaatattactttatgccatcaaattggcaaaagctaaaatagttgtataatgttgggaggaatatgggcaaacaataatcttttactttttattttttatttttttaaattttatagaatatatttatttagtggtaagcatctttaaattttatactaaaattttccttctatagaagatgatcataatattttcttttttttcttttattattatactttaagttttagggtacatgtgcacattgtgcaggttagttacttatgtatacatgtgccatgctggtgcgctgcacccactaactcgtcatctagcattaggtatatctcccaatgctatccctcccccctccccccaccccaccacagtccccagagtgtgatgttccccttcctgtgtccatgtgatctcattgttcagttcccacctatgagtgagaatatgcggtgtttggttttttgttcttgcgatagtttagtttactgagaatgatgatttccaatttcatccatgtccctacaaagacatgaactcatcattttttatggctgcatagtattccatggtgtatatgtgccacattttcttaatccagtctatcattgttggacagttgggttggttccaagtctttgctattgtgaatagtgccgcaataaacatacgtgtgcatgtgtctttatagcagcatgatttatagtcctttgggtatatacccagtaaagggatggctgggtcaaatggtatttctagttctagatccctgaggaatcaccacactgacttccacaatggttgaactagtttacagtcccaccaacagtgtaaaagtgttcctatttttccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgttttttccttgtaaatttgtttgagttcattgtagagtctggatattagccctttgtcagatgagtaggttgcgaaaattttctcccattttgtaggttgcctgttcactctgatggtagtttcttttgctgtgcagaagctctttagttaaattagatcccatttgtcaattttggcttttgtttccattgcttttggtgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctcttatttttattaactgttgttaagagaacaggctgatgcaaccagaaatacttagtctaatgatgtttgggcatatcttatgatgctgcaatctcactcttgtttgtacagtatatttgagagaacatctagccccaatttcataagggaacacatagaggatattcatcaccatggtgtttgaactagggattgtcaaatatgaccaatgggccaaatatgtccacaggcatgtatttgtgcactgtctatggctgcttttatggtataacagcagcaaaatccttaaaaccaagacttcagaacccccaaagccaaatatatttactgtgtcactctttataaaaaatgtttgctgacccctggtttaaagtatcagggaacattagacaacctagatgttccattgcaggggaaaagctaagggaactataatggacacacagtatggaatattacgttactgttataagacattaactacgtgagacatatactcataaatgcagtaagatccgaatgtaaggaagaaataaacagaaccagtatacatgaatatacttttatagaattaaaaatacctacataacaacaacactatacaatttgcaaaaatatacaaaatattaaggtatcatatcaaagacattatggttgataaaatgaggagaggggacacatgaataaaatacaccatgagagagtctttgtatgagtcttacaatagaagtatgctatgaaatcagaagtgtgattcactcatgcctctatgcctgagattcaaaaaataaatgtggaaaatgctgagtacaatgctcagtacactgtgattttcaaaaagcatgcattaccatcatcatcatcattatcatcatcattatcaccttattattaatcttttgaaagtgaaaccctaaccatggagctaaaatcaagaaagaagaacatgcttaagacaatcttgttgcatcagtgagcctaggataatcgattgaccgtcaccctgtttagaaaaactctttaggggtcaaaagagttttatgactccttttatgactaaaatctgtgaattgattgatggagagggtcaattgtttcctgtcacagtcactatttgcactcgtcaatatttctgtttctttgccttccagattggctctttatcctggtcttccttttagttggccagagacttgtgactagttctgactgaggagctgttagtgtaagtgttgtgtgacccttgtggaccagggtatcagttgctctttctagaccctccagaactctctatcctgctggcactgtggctagctatgtctgcagtggtggtgtctctttagtccctagaggaccacaacgaccagagctaatgcagtccaacaatggatgtgttgattgaaatcactgagatttgggggattggttgttacccagcatagcctagcctatacactgactgacacaccttccaaattttcaaagacctggaagcttaaaattggaaagaccctcaaatgccatgcaatcaaaaccccaacatgggcagagggagtgaatgtttagaaagagaggctcagccctagtgataaagagcccacatcctcctcaaaagctcctgtcctttttcactcacctcttatcattattgagattcttctgtttggagccaaatttcacctcctggccactttgactcatttatattagttctgcctttatccctgtttcacacaataattcttcagctaggggagtatggtagtcagaagaatggtcccctaaaagatgtccatatcttaattcttggagcctatggatttgttacctcaaatggcaaaagggactttgcagatgtgattacattacgggtcttgagatagatagaagattatcctgcattgattgagaaggctcagtgtaatcacaagggttcctataagagggatgcaggagggttcgagtgagagtaggagctgaggcagtggaaacagaggtcagagagatgcccctgctggaagaaactttgagccaaggaacccaggctttctctagaagctgaaaagaataggaacagattctctgtaccccctctctaccagcactgattttagccctggaagacccacttcatacttctccacaaactgtaggatataaatttgtgttgttttaagccactaagcttgtggtaatttgttacaagaggaaaagaaaattaatacagtgagattaccatgtttctttgaattttcagtttccagaagagttgccttttgctacacctggtttctttttcagtctggtcctctgatattttaaaaactggtttcatcaatccagtttgtaaaaatatgggatttctagaactttgtttttattctggttgtgacttacttaagaaaggaaattgtagcaaaattagcactgcctagaacagtcaccaaagcaacacagactctctaagcagttcattgaacttggtacctacccagactctaaataaatatttttcgtagttgatattgctgccatttagacagatctccccaattccatagtccatagttgttcagttgatttagggggaattaagtgtggattttattgattccttcagattaccaagtaagagttagttaattcatgagtcatgtatttggtcaaaactaacagcattaatagtctgtgttggaactattaatgagaattcaagagtctgacaaaactttgtcagatttgagaaacagaagaacctgcctttttagggcaaaaccatattaatagcatttttaaaatagatttgtatgttctagggtccttatcgaataaagcacctattgccttatccaaatctcaaaacaatcatatgaagaagggagtattattattattgccgtttttaaaacaacaaaatgtcattaagggttgcttaagcaattcacccagttttcacagctagcaaatgagggagctgggctgaaaccaggcagtctgactgtgcagctggtgccttaaaaccatgctacagaatcactcataacgttatagctgtatggtccttactggcctgtggcttagatgtgtcttattccaggtccagaggctgcctggagtatgtggacactgtccttggaaatgaaatgacttgtcagctcatttttgatggatcacatttcttagaataagcacaaaatattttccatttgctaagtgattttatcatgcctctctgggctggactttggaggggagagaggaaacaggtttcatggttaaagcctgagacatacctttcaggcagtcatgggtgaggggttagtaatgggtgacttcggcccctcttcatgctcacctggcacaggaaactctgggtggtttggctccagctcttgaaaacaagttccttgtttgccctcctgagttgatggtctggtggagaatttgtctgaaggaatttgttccaggaaaggtccagctgcatttgacaggaaagggagaaaagagagaacgaggcataaatctctggccttctgcctcttgcttgggaatctgtcctttccagcctgtaagtatggaaatgagtaactggtgagtctcaaagctttgaatgaacgtcatacccctgggcagacatgtgggccccctgaggaaagaaatgtcccttttcatagaaaacatctatatccaatattaaaaagcttacattagccattgggcacatgaaaaaaacattcagcatcactagtcattaaggaaatgcaaatcaaaaccacagtgagataccccttcacacccacgaggatggctataataaaaaagacagacaaacaagtgctgctgagaatgtagagaaattggaaccctcatacatggctgatgggaatataaaatggtgcagctattttggaagagagtctggcagttccataaaatgttaaacatgggttaaccacataactcagcaatttcactcttaggcgtataccccactcttaggcgtatacccaagagaagtcaaaggttgattgtagcctcttgggatatctcagccatcttgataatcagtgtccccacttttctctccccctcatttatttaatgttgtatgattccatttttaagctgctgataaagacatacccaagtctgagtaatttataaagaaaaagaggtttagtggactcacagttccatgtggctgtggaggcctcacaatcatggcagaaggcaaaaggcatgtcttacatggagggagacaagagagaaaatgagggctaagccaaaggggaaatcccttataaaaccatcagatctcatgagacttactcactaccaagagaacagtatgggggacacagcccccatgattcagttatctctcactgggtccttcctaccacatgtgggaattatggaagctacaattcaagatgagatttgggtggggacacagccaaaccatatcacatgccctattcactaacgataaaaatctgtccaagatgaactaccagctgcccacctctcaaccccttccactcagcctgcttcacccagttattctgtctgcctggccctggaacacttttgggtttgagatggactcaaattagagagtagcattttgtgggacatcacaaagggaaaatgggacactaactaaagccaatacccctgtcattggcagctatcagaaatgaggtgtgggcctcaaggcagagtcagagtcatggaattagaatagtggatgagaggttgggacctagatttcagcaaacaataatgaagggcaaaaggaaaacaaacttctccaacataaaagagaggagtcaagccctgtgggcctgatcaacagctggtccttagtgaaaaaagacatgagttttaaaaagagcagaatatgaagtttcaccttagatcctgggacttgatccttggaacttccgaaggtttttggatccttggaaacccttaggaaaagcagcaactctctttgaagggttttctctgttggcaattattaccttaaagtagaatgttaatagtcagccagaagccagttccaagcaatccatcagacatgtctacatgggtctgaactttactcataagcaaggctaaaattctgtcctatgggtctgttgggtcccatgttaaccaacttgaaagtatcagcgaagggatgacaggtgtcatgtaattctacatcctgatgtttccagctgattgattgatagaataatttctagtttcatttcttcaagcttttgtttttttcaatcaatctcttctcaaatccaaaggtaacttgtattctacaattcttatttgtctttcctgactgtataaatgtatttctaagatttaccacacacattacttacttatgtgtaataggtaaatgtttaaaatgtatttgtctgacagatttgaacatgcctcctctgtgctttctatttaccatgtattttctttgttcactccacaccccatcctatttcctgttttctcttcagatgatccagcttattttatgttttcgtgtttgtttttctttgtcgggaagttatatattgcctactattttagtagttatcattaaagtttttttatgtgcataatcatcttaacaaagtcttaaattaagcaacctgtctctttcttagcttccaaaaaaccttaaaattctttaacttggttttacccactttccattttcatgctacagcttctagtatcttatttaccctatgatctgctgtccactaaataaggcattgttattattacaattattacattttagagcaattttaaaagatttgccattgcatttaccaatttctttttaacattgcttcataatacttcttccttgttagatcaattttccatttttctgaagcctgtcctggtgaaagaaagaaaccatttgtgatttgtgctaaacatacccatcatcttccataattgcctcagcaattttgcagaatatgaattattatccccattttacaaattagaaaagaaaggcacagagaggaaaatgacatgctcaaacaaatcacaatactgatgtatttcagatgcagccagatattttgataaaatacatctttgagtggcgaaagaagcaatttgcttagagttaaatagaaatataatgggttcatcaagaaacaattggggggttgcagagtacttgtagacaggccaaagtgcttaaactcaagtgatttgtgcaaaagaaaaatccattattctgaaaaaattgctttaacagagaattttcaaagcataagagttgttacattcagcaagaaaaagggagggagtggtgagggaaggtaacgttatcacaatgactaacttgactttattttccccaaatttctaaatcttacagtttaagaggaaatgctttggggagagataatctttaaaatttgttcactgcattggtttttaaattttcaaaagcatatctgaattaaaggatggataagacactttacatcaaaattcactcagggctgatatgtgatgactggtgatgtttctaaggataacattatgaaattagttaagaacaggaaaaagactttaataattcattatcagtcattacctttggtggtgtttgttattgtttgtaacctgaagacctatagggataataataacaatagaaatgataattacatttttaaaaaataattcaatactaagcagattacagacaagcaacacgattagacaggcagcactcaagataattcactcagtctgttgatggattccacacttctcataagcataagattcattttcacaattaaagctagatcattaaaattgcagcctgttggcagtaacactttttgcagcccaaattctctttaaaacaaaacttgtagtcattagaatggtgacaatgtgctgaaaacacccactttggccttccctgggcattctgttcttcctggcttgcacttcaacaagttgacagccttattttgtaggcaactttagtagattgtcaactctggctaccacctatcctcaggtaggatggagcagaaattttattcccttaaaaaaaccgcatcttgcctaattcaagggactgttgtgttgaggattcagggtgcaggcacctgctgcccacaggcctttgggtggtgtgagaacaccagaatcaggttaccgtcactgagttgccaaaccacattctgattctaatgctggccagctgtgtgcccttgggtctttgactcaatctttctatgtcttggtttcctcatctctaaaatgaaactgcggtacccaagccctaggactgttaagaaggttcagtgaatacaagtgaagctcttcctgatgatatctcaagcaccttaccctattagtacacatgaatcttcctcattattggaaatgattgattgaagaccagttttatctcagaaggctgagttttcacatgaagacttttttattttctgtggtttagttacctctatacagtggtcaacaagaaagttgcaaatggaatcaaattcacaaaaatacatttcatgaattaaatattttcatgggctttgccaagggcacacaattaagctctgtgttgctcgatttctgggtgctcatgcatctgctccttcaaaacaggttagtgctttgatctgatgggccagtgtggacaacgatgctgggcttgtgagtggcctccgtacacagagctcctgaaatgcaagaccaagtaggccaaaatttcaggctgtatatgttcaaagctttgctaaaactcagtgtggcagaccttcagcttctactctgtaaaccctaaaggccatatagcagttaactgaatgttccagaatttccatgatgtgtttctgttcaaaaattcagtcttaaaatttcgttttcacttgaacttgacagcccctgaccttgtattttggagttggaaaatgtgaaccaatacacataatagctaattcccagtggggattctagacaaagaagataacgtactagagtgaatatttgttatctttgtaaatattatctttgtaaataaacaatagcaacacaaagttctataatgctgatgacttcatgaacaggaagaacagaggaagaagggaaaagggatgaagtcttctagcattggaccatccagtgttgtagtcaccagtcatatgtggctagcaagcacttgaaatgtctctagtctgaattgaaatctgctgtaagtgtaaaacgcacaccagatttcaaagaaggagtttgagaaaaataacagaaaatgtgtcattgataatttttgtattggtttcttgttgacataatattttgcctatattgggttaaataaatgatgctactataattataaacgatgctactataattaattgtattcacttttcactttttaaatacggccaccataacatttaaaattacatattcagccaggtgtggtggctcatgcctgtaatcccagcactgtaagggcaaggtgggaggatcacttgaggtcaggagttcgagaccagcctcgccaacatggtgaaaccccgtctctactaaaaatgcaaaaattaacaggatgtgctcacttgttcctgggaggcggaggttgcagtgagccaagatcatgccactgcgctatagcttaggcaactgagcgagactctgtttcaaaaataaataaataaataaataaataaaagtacatatgtgactttcattatatttctgttggacagcttcctttaatacacaaagataatttcctatttattgtatgtaaatagtgtcttcagcagaatggaagcaatttatacttatttatttacatatgcttgccaaaatatcaatttcccaaaaaacatttctcacgtagacctgaggtcaacctaaaccctgtttctgttccacactcacaaattatgaattagtgaattctaaatgaaagcaggcccaccacatttagcacatgagataaagaggaaataatgcgactcatctgtaagcttaagttaagtttggtttagaaaagcaatgagaaatgtgacagtcccactctttaaacagacaaaatgaaaaatcataagcaaaacaatctatgtgattgtatgttctcactcacatgtgggagttaagctatgaaaatgcaaaggtataagaatgatacattagtgtttgaggacccgtgggggaaagggcagggggtggtgacggataaaagactacacattgggtacagtgtacactgctcaggtgatgagtgcaccaaaatctcataaatcaccactaaagaactcagtaaccaaatgccacctgtttcccaaaaacctattgaaataaaaaaatcaaaattaaaaaaaaaacctatgtggatttaatgtatcattcaaagatgcttcagattttgatgacagagggatgtggcagctatttaccattctggtacctgtaagtacctacaggttttaggttttttatcctaggatgcttccttcattcccatgagatgtttcagtagagaggagccagcgcagcttccagtcagagctggagaagcgcagagactgtacagacagcaggataccctggatcaggctggattaagttgcctgtctctgttctctgcatctccaatccattgagaaccttcattgaaggaaattctcttcccctagcctgtgacattctgagcttattctgtgaattttcttcatgcctacacctctgtgcaaatgacagtaatcaagcaacctggctgtacagtgtttggggagaaaagcacttggctcaatgacatctgcagcctgctgcctatactgaattgctgtgtcctgagccaaggctgaggatgcctgttacaataagacctcttagcaagagacggcacactgaagacacagctctttgtcagaagcgatgaccagaggtaagacaacagtgttccagggcaccaaagctggcatattattgtacagccttattgttaaatgctcaggaaagtaacataaaatgttccagaaagcatatatatgatggctctaggagtcagtcagaggaagagattgggaaagggtggagcacaacagctttcaagcaaggaaggcagggtggaggtagctggcagtaatatcagcaataacactgacagtaaccactggcctattgagtacttactttgcatcagatactgtaattgcttcatgtgtattggctcatgtactttttataaccatcctactgttctctctattttatagacagagagctttggatggttgagtaagttgcctagtatcacatagccaggacataggtaggcagatctaggatacaaacgggagtctttctcactccaaagtctctgaattttccactgtgccaagaggacaggtcatgaatatattctatcctcttattcttcaccactttgagaaatttgtgagcattgcccatgtaattactattcatctacagctctagataagtggtctcaaatgagccccagagaacatttggcaatgcctggagacatgttttgccaccactggggtggcgggtgctactagcatcaagtgagtggaggctaggggagctgctagacattctataacacagaggtcagcccctcacacagaaaagtcttagccagccccaaatgtcaatagtgccacattgagaaactgcaccagaggaaaggcatggaaatcaatgcagaaccctatctcatcctgccccatctaggtcactccatagcttggttggtcattcattcattcagtcatatttattaagcaccaaccaagtggccaatgccatgttaggctctgtggacatacattattaaaacatcaaatgaagttattcaatatttgtcaaaagtatagttaaaacccatatgccacaggtctaagtagtatagaaaggaggatatttcagggaagtagttgatacacaaatgttttgagaatccaacatgctgctttacatgttttaagaaagataagaaagaagattaaaaaatatttacatatcagtgcatctttatttgaagttaaatctatacttagtctgtatcctgtcaatgctatgttttcgtctaactgagtttactaaaatgtacaaagagctttcctataacatttaggaatttgttttaatgtatctacaaagaatattgacagccttcagacttaagtgtcagtcattgaaaattatatttgctggagtgtttgttgtagaaaattacatttattcacttacaattgaaacaatggctgtcataagaggtgaagtgtgttcatctatcttgtattaattagcccattgactaaggcttccctaagcttgtaattaaccaagtctgtctgtgagaacagtggtattaagctagcaacacttttgagagtcttctttgcattgatttatgcaaacaaacatttaaaagtaacttgaagagattaattttgtaagacatctcacaatcttccacagcacaaggaattcaatagttagaaaaaaaaagtgtttctaaactcaaaagttaactgcttggcaagggaaacaaaaaatcaaagaaataatcacaataagaattaaaactataactgtcatggctacaaagaaagagagactcaaagtataaggagtaaacagaatggggaacatgacatggccagtggtgtggagttgggggaggcttctctgaggaagtggtatttgagctgagaactcaccaaagtgcagaagttattccaggcagagggaagagtatatgcaaaggcttggagtcagagacagtttggtgggcggtgtgcctggttctaagggagtgtggacaagtgcagtgtctgatagtcagaagggtaggcagagcttgtacattgtgggtccaggcaggccacattactgggtttacttcttttttatattgacatcaatgtggaataatcaaaatgccaaaatcaagaaggcaaaatgagaatgttcattttgagaagctcactgggcaatgaatggatcattgcaggagctgagtaaaggcaaagagaccaactagcagataattgtgccaaccagtatatagataatgatggttggaaataggtcaatgacaatgaaaatggggaagagtaggtggattcaagagaaatttgggaggtaaaatccacagggctttatatacaatggattggctatgatggcacgggcgagggagatggaggtgtttgttaaatactttttattgggcttaagggtttatatctcatacactggggacagcaaaaacatggctgatgttatggcagaagtttcgtgagcacctgcactgtctcctatgaacaggaaaaagggaaagatcgttctattcccctatagtggtgtacagtattaccaggtgcctaatatggcctttaatatagaggaaaagaaccatcagctctgcaacaggaggggaattctggggcatctgaatatttaactcaaggaattcaggccctgccaaatctcagtcacaatgcaaacctttataccccatttccttctgtgccaataatgacatttggaacaggagggagaagtctactgaaaagcaagatcctcctcagcaagcacattggtcaatccctgctgggctgtctgtttcagctattaatttgcatgggctgcttctggactgattctgtgatggatctgttgccaagatcagccattaaaagcttacttgcatttctgctttctagacatgtcatatcatgaggccaagaaagagtggacaggtacataagctatggcctgaaatggaaggagatgagtctgttgccaacagccaaggagagtagtaggggtgactagaggggaggggaggagtggaaatcaggtttgaaagagacaaggtctcaacctgagcccaggcaaaggacagccactctctaaagtgtggcagcatgggtttctagaagaactttggagtttgacctcggctcatatcccagctctgcaagaagtgagcttaaggcaagtcatttcacctctctgaaccttggtttcttttgaaaaaaaaaaaaaaaaaaaatggaaaccatcctgtctactttggatggtggtgagaatgaagtgatgttgccacaagcattgggaagcctttggcttggctccaggtctgtctggcaaacacttggttttaaggaagtaaaggccacagatgtaagcctaccaccatgcttttgctcactgacttcctcccactatcctagaccaaaaccatatggacccctaaatactgacagtcttgagttcaatgcattatctgaatcagtcagtttctccattgactgaaggcaaagtggctgagatagacatttggatggaccttcctgtataatgtaaacctatctctctgaatcagctggtgaggtaatggggtgttagtcacatgcacactgagttgttagggaatattaaatgacatcactccacttgttattatttcatctgttaaaattaggtttctgcctgaaattgcttagtgacaatactcctggactttcttcaaaagctgtaaagatggcctctcgaatttagaaaacgctgaaattgttggaaagttttactaagctgtttagaatttaaaacagcagcttccagcaaagcagttgagaaataaacagcatctcagggtgttttccagttccttcatgaggcaataactcaaaatcttgtcacatttggaaaaggagacagatcaaatgtctaaacattctaagtgtcttcaaagaaaatacttctccctctggaacagtgagtctggtattaaacaacatgattgcttgatgagttttatcatggcgtcttagacctgggaaatatcttacaagtcatgtctcagtctttttcccaagtcaatgaaaatgtcatttgctttataaagaatgggtatttcacaagtttcccttgtaaattttttaaaggctaaattcattcattgcaaggaaactctggtagatgtttcattcccatttttcactttcgtctgcacctgtcctgtccaggtattagaagagacaatcactttctcatctgagaagatcctcccttctttctgacatggtcaggttctattttatctcaaagcttatcttttttataacctcctttgtgagactctttccctacctttggggaaatcacactcctacttgtactaagtaatcttgcaacagtgtctatcccctctcatcattagtatgtgtgtccttgaatgagtttttcagtgtacagtcataatcctttgaggtttcaggtggacaattagtcctggctattgacactacaatgctggaaggtactaaggagattgttaaagcattctcactttactgctgaaataaccaaaggccagagaggagaagccatttacctatacatacatggtgacataagtggagcacatactagaccttctgactttcaattcagctttttttcagctatgatgacatgtcaataggttcgcaattggcccctggttcttcagagacattcagtcagttcttattgagtgaatagatactgaatgagtaaagaggaacattttcttaggaatttagttttaagtacaacatggatgccatgtcagatgaaagcactcacaacttcgtcatagataaatgtttatggaaggccccagtgatgggattgaagggtctcatcctggaactgactggagatcggtcaggaagaatcaggaagaatctgattctatttggattccaaatcttgtttgccaggtcatgtatgatgtgaattcagaagtcaattaatttactaattcagtcaaagccaatgattctggaagaggtgaaatagcattattggagttgaggataagaagatattttgaattctcagtagctcaaacttgccaggggcttcctattctggcccaggtaccatcaccttgggaagacttccttgtcagctgccaaaatctcacttcttccttggcccctgagaatccatcccttgctccaatagccagagctactaatatccccttacctcagtgcagtcaatggaagtgattggaaactctttcctctacttacataaacacctgcctcaatacctagcaggtatctacttctgcctacctagagagaagtggatacatttctggatttgtcagaataaatttaaataaggctgaggatccattcatggaatcttgtccctctggtgatcctcaaagcaattaacaggggggtataaaaagtacttggatctttgtgagcaaacagagatgctcagtgtaactgtagcttgagtacaaagagtaaaactgtttaatttgtgctgacactctagagaagtcaagggtagagagatgaccgttgtgtgagataggaaaaaacaaatcatgtttcttactctcatactcaacgcagtacacagaacacttctaacatcaaacatgtaaatttttacccacacattaatcctctggcagaacacccactaggtgtcccgaaatttaattaaattctgactatctacatttagttagactcagatcccataggttaagggatcagtcccacaggactgctctgacccccccacccccgaccaaacttcagatgccaataacaaactcaggcctcaggaacatcaggctgactagctatacaggggagatttccacaactctctcctcggcttccatcatttgctagagtggctcacagaactcaggaaagtgctttatttacactcattgatttcttagaagaggtattacaaaggatgcaaataaacacccagatgaagaaagaataggcattgaacttcctccaggaaatctccatgctttcagccatacagaagctctcctatagcttggggattttacgtaggcttcatcatgttaggcatagtatattattaactaaatctgcagctccactccctttctcagaggaagggagtggagctgaaagctccaagctcataatgatggcttggtcttcctggtgcccagtcactatccaagagcacaccaagagatgcctcagaacagaaaagactcttattactcaggaaatgacaagggttttaggagttccgtgctatgaactggaggcagagaccaaatatatatttctcattatattacagtattacagccatgttaatggatggatgaatgtgtggatggtttagacaaattgttctatgaacgaaagcctttcttgtatcaacacagaacaactgacttgacttttcagaattatgagcctaaataatttattaaaggctaggaagacaatgaatttgcttaactcaaacttactgtctttcctagacaatttttattctcttttacttctagaaattatatcctatcctccatgcccttataacactctgtagtttgctcagctacatttatgtctttatggtgacttgcccatctgttttcatgaggctgtgagctccttgatggcagagactgtctttttttctttttatctatgtgttattatcgttcactttttgttttaaaataatttcagaattatagaaaaaatttaaaagagtatatgacctttacttagattgtctgcaaattttaaaaatgtactacatttgcttaccgttctatctttctatctacctatcacctatctacacacacacagacacacacacagacacacatacacactttattatgaaatgtttaaatgaaggttgcacatgatactcctttacctctagatgtttcagtacgaatttcctaaaatcaagggcatcttcttatgtaatcacagttaaatgatcgaaatcaagaaattaacattgattcagtactattaactagtcaatagaggccttattcaaagtttactagttgtcccactaaatccaaggttccaagtccaggatcttatccacactcacaggttgtatttagttgccatgtctgtctaatccatcatgtccttttgttactcttgaatctggaacagttcctcagcctttctttgtcttttataaacttggcacatttgaaaaggagagaccgggtatttagtagaatgtctcttaatttgggtttgtctgaggtttcctcataattatattcagaccatgcaactttggcagaaaaaccacagaagtcatgctgtatccttctcggtgcatcatatcatgaggcacatgatgttgatttgtcctgtttttttgtgatgttaactataattgcttcattaaaagagtgtctgccaggcttctccactgtgaagttactatttttctctttgcaattaattagtatcttgtggggaaatactttgagactatgcaaatatcttgtttctcatagtactttcacctactaattttagcatccattgatgatccttgcctgaaacaattattactcttgtggttgccaagtggtgattttctaatctcatctttccttctatatttattagttggaattctgacatgtcttttccatctgtgtcctcattgcttaggtcagtctggtccaaagaaggtattattttgtgtgagttgttctcgttagttgcttagtgttattataaaaatattacaagcaacatcattgttttaaagaagaaagcaggcaaacatggtaaattgtgctattcaataaactttatatgaattgtaatttaaataggtcttttaaaaattagcatagacaaaggcactttgtaaacatcatcagaatacataaactgtggtccaaaaccccttacataaatgagacaagtctccaggataaagccttccatcctctctcaagtgagtgggtgtcagctgtctcggacatagaggactgagtcatacctgagactatcctttgcttctgggtcagcaagttacccagaagaaacttaacattgtgatgacacacttgagaaagattggacagttttcacagacagtttcgtcttactctctgttcttcaaattttagtttttatttctccataacacaaaaacaatggggcaaatttatttgctgctcctagaattctttgaatttcaagatatggatatattgttacatttctatatacatggtaggaccacaaaaagggttaaataaaagcattacatagatactacttactcctcagggtcctacagacatcttctcccctatcctgtttcttctttctcagcctccttgtgcagcgtttctttgtcctaaacttgaccttagctgctgactagtttctcccatgactcagccaaaatactgcacaagcctttaccttcagtcctctggggttttgcatctgggcaagtggctctcttttctgggcaagctctgatctttcttcctggaaccctccactgccacatctgtcagtttgaggtctctgaccccatctggctttcctcctgggacactggccctctcccaaggacagccagaactcccaagttaattatctagagtcatattgcttccctgtctatcctgacttaaaagggggaaaaatcctgcttccttttggttctccagaataatttagaacttttcagaaagaattacaactataaaacaaggataaaacagagacaaaaaggttaaatagaaaaatagtttttaaagactccaaagttcatatcaaatttagttttaaatacagattatattaagtggcctaagttagactactaggacccacagtactgatcactacaccatccattaattttatcttttagggaaagcccttgggtgaggtgacatctgtttttagttttaaatatttcttggtcccatcttatggaaaaggaaccaaggtatagttccacaatctcatgaaactcccaactcgatgaggatcaaggctatggctgtggtattcacagacaaatcttctgaggctcatataaagtctgtagtagagtaggtaatccaatgatcatgcacttaaattttctcaaaacattctcccacagaactttagcaaattcctgaatttccagtatttaggcaccagaactatatcttccaaactgcagaattagaaaacaaagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatcttaacgttggcctgccttgctagatgggggaagttctcctggataatatcctgcagagtgttttccaatttgtttccattctccccatcactttcaggtacaccaatcagacgtagatttggtcttttcacatagtcccatatttcttggaggctttgctcatttctttttattcttttttccctaaacttcccttctcgcttcatttcattcatttcatcttccatcgctgatcccctttcttccagttgatcgcatcggctcctgaggcttctgcattcttcatgtagttctcgagccttggttttcagctcctttaagcacttctctgtattggttattctagttatacattcttctaattttttttcaaagttttcaacttcttcgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggagtaccctgccgtgtgaggtgtcagtatgcccctgctggggggtgcctcccagttaggctgctcgggggtcaggggtcagggacccacttgaggaggcagtctgcccgttctcagatctccagctacgtgctgggagaaccactgttctcttcaaagctgtcagacagggacatttaagtctgcagaggttactgctgtctttttgtttgtctgtgccctgcccccagaggcggagcctacagaggcaggcaggcctccttgagctgtggtgggctccacccagttccagcttcccggaattcaacaagaagagctaactatcctaaatatatatgcacccaatacaggagcaccaagattcataaagcaagtcctgagtgacctacaaagagacttagactcccacgcaataataatgggagactttaacaccccactgtcaacattagacagatcaacgagacagaaagtcaacaaggatacccaggaattgaactcagctctgcaccaagcggacctaatagatatctacagaactctccaccccaaatcaacagaatatacatttttttcagcaccacaccacacctagtccaaaattgaccacatagttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacataacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaattgaaggaaatagagacacaaaaaacccttcaaaaaattaatgaatccaggagctggtgttttgaaaggatcaacaaaattgatagaccgctagcaagactaataaagaaaaaaagagagaagaatcaaatagacgcaataaaaaatgataaaggggatatcaccaccgatcccacacaaatacaaactaccatcagagaatactacaaacacctctatgcaaataaactagaacatctagaagaaatggataaattcctggacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaaccaaaaaagagaattttagaccaacatccttgatgaatattgatgcaaaaatcctcaataaaatacaggcaaaatgaatccagcagcacatcaaaaagcttatccatcatgatcaagtgggcttcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatatttgttggaagttctggccagggcaattaggcaggagaaggaaataaagggtattcaattaggaaaagaggaagttaaattgtccctgtttgcagacgacatgattgtatatctagaaaaccccattgtctcagcccaaaatctccttaagctgataagcaacttcagcaaagtctcaggatacaaaatcaatgtaccaaaatcacaagcattcttaaacaccaacaacagacaaacagagatccatatcatgagtgaactcccattcacaattgcttcaaagagaataaaatacctagtaatccaacttacaagggatgttgaaggacctcttcaaggagaactacaaaccactgctccatgaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcacactacctgacttcaaactatactacaaagctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatccattccttacaccttatagaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaacgctcatcatcactggccatcagagaaatgcaaatcaaagccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatgtagaactggaaataccatttgacccagccatccctttactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcgtattctcactcataggtgggaattgaacaatgagatcacatggacacaggaaggggaatattacactctggggactgtggtggggtggggggaggggggagggatagcatcgggagatatacctaatgctagatgacgagttagtgggtgcagcgcaccagcatggcacatgtatacgtatgtaactaacctgcacaatgtgcacatgtaccctaaaacttaaagtataataaaaaaaagaaaaaaatatattttcagataatttctaatggcataaatggttttgcagagttttgaaagccagtgtaacttttagtagcagtttcttatgtacagataatcaactattaataaacttcatttaaataaagtaaaaaaaaagaaaacaaagtcatgtgcaaaggaacaactctcaattggaattaaaaacataacaattgttacagcaacatgggtccatattagctagggtaaaaagcctggtatctaaccagtatgttccttgcaacattttggaaggacacagggaagggtatagcttattgtgcataaaatctgtagacccaagatcaccaagaattgagtgaagacaagtggaaatatggaagcagggggtaatatggtgaatagttgtcttggataagcttgtcaatgatcatatcattttccctaaaagaaatcaagcctttaattactttataatttttatataaaatttgtttttctcttattttgacatacaaatgtggagtcttggattagacttgctgacactgagactttaggagacaggttcagtagctgaagtttcctcatctataaaatgggcacattacttatcatgtaatgctgttatgaagattaagtgaaagagaaaatatcttgcatgaaaccagcctatttgaagaacatgctactatttcactctttcttaactttgtccttctgtctggtggtaggcataattttaataacagccaccaagtttccataccctaatatccggaatctatgaactatcacctccatgattatcttacattttaatgcacagttaactttaacacagaaagattatctgcctaatctagtttcacgagcccctttcaaaacaggattttctccagctggtaacagaagaggactgcagagggtgtcagagagattttcatcataagaatttgatggtagcctatcattgttggacatttgggttagttccaagtctttgctattgtgagtaataacctaaaacttaaagtataataataataataataattaataataataataataaaatttgatggtagctttgaagatggaggggcatgatgagacatgagaagctgaatggtccccatctgacagccagtgaggaaacaggaacctcagtcctatagcaatgaagaaatggattctttcaacagtctgaatgagctttgatgtaggttttttccccagtttctccagataagagcccagcccagctgacactataactggagctttgcaaaatactcagcagagaaacctgttgagcccacctggacttccaaacttatagaactgtgagataaaaatggtgttatttgaagccattaaagcttatggtaatttattatgcagtaataagaaatagataaacatcctttctttccttctttttccattaataaacatttatttctggcatagcatgtgcagggtacagcttcagacactataaaactcagggcatttaattctccaaacatctctaagaagtaagttttaatatccccattttcatgtaagggtgaacataggggtataaattttggacactgtctggactttaacccaaatcctattgcaacattttgttatttccattttcccctctttcctacaggattcaaattttcctctgcccaagtggtcaaggggggcagaaggccctaggagaaggggggcagtgaggcacgcattactcctgaggtcgttatggagatagtgcaaattggatgccagcaccatgggtcacagtggcacttggagactttaagaagtcattattattgtcaagcttgctccccgcatcttcccctcaaattctcagaattgaatttggcacagttagccagaaggcctggctctgctttggagtgcatgaaaagggattatgataacaatgataacaattaatatttaataactatttattctgttccaggcatcaattaatcttcaaatctaccctctgccttggccagggtgctgctgtgccaagccttattggtgcctgaggcagaaggaaaaatgtatactctggctataatggaagtaaacacatcaacaatattttcaaaatctacttcattgctagtttcattttcaaagaagagaattgtcatactgacaatttctcttcacccagtgacaattttgaatacattttcattaactgaagctaaattaaaatgatcataaatatatttgggtatatatactatacttaagctgagaataatgtttattttaatacttacatttcatttttcaatattttttcaactattttaatattctgcaaaaaaccactaggaaaacacataaaaatatgtatagaaatgtgtgcatgtacacacacacacatgttttgcctcaggctcaatatggctaaatagatcaacagtctttatttaaaattttgattattttcatcatggattttttttgcataaattttaatgtctaaaaatatattgtattaaattattatttaccgtgattactgagtttcttgacaactcctttaattttttggctgagtgacttacttatcctagttttggcccttgttcagagcaaacacccagcttctcccaaggggcttagcctctctagacttttctgtacattgaagaagatccaaatattgactgccttattttccaggcatgtattggtgaatttagacatttcaaagtctcaaagtgtctcatttttttgacaactttagcctgtcctaggttatgttacataaacatagggctttgcaaagctttcgtttggaaaaaaaacaaaacaaaaacttacaaaaactgtagctgcacaaatatagcaagaattgtaatgctaatctgagatgtattcaccctaatattgagaggcatctggaatactgctgggggccaatgtacatgcagagtaaaggaatcttctgggagagagagaagggaggtgtgcaattttctacaatgagtaagtgttaattgtttggccaacagtgtctttattgctctggtaataatagaaaaaagcagtaatacaaatatattctgggtcataaagatcactactcttagttttacttttatttcactatacttgcatttgtgttttaatgcaagaagcccagcaccctgccccaccaaaataatttaaaaaaaaagataagagatcttaccgaataaatgaggtgttcattctaagtgaaggtcagtggatatcttcaattcatttgtatgaataaagctttcatagcagttcaaacaggcaaacagcgtgaggggatggggacaggaattgaatcatggcacagtgcaccatagtatgggcttgtcaggcggcaaagatactgtaaaaatatagctatcagtgtcatgttcagatttcaaatggcaatttaatttcaggaacacaatacaagatgccacactgaattgatattgttagttcaaatggaatggttattattgttttgtttccattgaagttgtaaatgtgttttttgctatagtcatacatgaaccatgaagataaacagttaatatagagctttattttatatactttgaagttatattatgacaaataatttatataaacattggacatacaggtaattttttttcccttcaaaaaggccattatgccacccaagtttaaaagcctggaactctaagaagtgtcccagttatttagagaatatgtgggatgcagagagaaggtggtgcttaatcctgaggggctaatagcttgtcgtagtgtctcttagctatgatggaggagatatttgagagccttaagccttctttacactttttactcataactgcagtctttgcttcatgatgaagctaatctgagcaactctatagtctgttcacaaagtgttagagcaaagttagaaccactcttgcttcctcctcacatcaaacagcctaatgagattgttagcaacattgtgagaacctgttatctttacatctcagcaagaaggtgtgtatgtgcgggtgggcatgcccacgtgtggatgaggtgtggaattgtcactgctgttgcacttccaaattctgggaactgtgaatttggctgggcagggtctgggcttccagccagctgctaagctgtccaggtagatgacacactaattaggggaattgcaaaccaattagcactttggctggattggctgatgtgtcttagcaacttcttcactgaatgttttgtgataagaaccagtccaatgtgcctccctaaacccctcaccatctagatgggttatccagtctgtcctggaaaagggaatgctttagccctagggacattattaatgtttcaatcctaaactgtcagcctttcttcagaaggtagcaattctcccctgagagatgactatcatgctttggggctggtgggctaggccagacctgcactgtgaagaggagaggcaaaaaaagaaaaagaaaaaagaaaagaaaagaaaagaaaaaagaaagcttgcctagagggttggaaggtcagtagctccctgttgaacacattaatctgtatggtcattgtcagcttggatacagattccagaattggttttatttttctttcttcagaagcatccttgctctcagccttctgcagactgcaggcacctagcctacctgccctcttccctgatagctctgcctctcatcttcactggtgttggttccctacaccaaccctgccctgttgacctctgctggcctcgtagcagagaaggagagggaaggctggggaccaaggaggaggggaggcacttctacaggagtatgttctgattaattaattttttcttttgtattctaagatgctattaatgcacccaaaggaaattgtttacttctaaatggttacaacacatagaaaagtgtttctcatttttttataatataataacaactatactaatttcttagtatatgacagcttctgagtggccataacaattttttaaaaaggaacaagggattatgttctagtgtcctcatcactatcttcctttataggaaaatgtgactcttagagcagtaatcacctctgggtgcctgattcgaatagttccctatgtgtatatgatgtgtatgtatatgtgtacatgtgacacagaactttcagtctaacctctagcatgtgagggattccatcctttccccatacataaagaaaggtgattttaaaagacctttttgaaaatagactaatcatagagttcagaacaatgtttccttagttcacggtttgtgtgcatgattataccaatttggtctcccttattcaagaaggaacaggtaagcaaaaatggtgtgtataattcaaaagaccattctcaacacactttctattggcagcctcagttgttcacaccttagcatctctacatgtctaggcaagcccggagagcttagcatggttgggattgggactttgaattgggaatacaggagccacttgggatggaattttctctaaacgtggtttatttcatttaccagatcttatcaattaccagtgaatctacatattaccatactgagaaacattctgaggagtgttgcaaatcatctataaggaatgcagaatcctttcaccaaaattgtcattgaggcaggagtcaggggtggtgatgtttgcaatctctgccttaaggaccagagaaagtcaacatacacaaaattgattaatgggtgagacagcatgattggcttttatcctgcaccctttcctgtctccacacacataccctggcctcatggatgcagtacattttcctgactcttgactttggagtagtcacgtgaatctgttttagccaatggcatatgggtaggagtcatagtgggctgattcagagactagggcaagaggcctcctctgcttccacttgctctatgtttctaccgtcattgtgagctaaacatgccctgactagccccatggttacaggagattgaaagacagagcagagatcaactgaactagccattctgcagaattgggagactttggagatggtttgttacacaacagtggttaataatacagtccacaaatgaaaccttggttactaaataaatgtataattgtgaatacagaagagtgtcattttcgcaatggagcacgaagaaatttacatctgagtcccagggcaagcggactgcaagcaaacactgccaataaaaatggcaagaagtatttcattaataaattataatagagactcaaaacctgctactgccaggcaaagcaggtttttagcccatgttgtgtaatgtcatacttgtagaggtaggtataaggatgcattggttttggaatatgtctataaatttttgacactcctaccaccaagaggtggattttaatttccttcctcttgattatgttccagccttagaagttagaaattacttgcatctaacaaatattatacagagcaatggtattgtatggtttctgaggctaggttacaagagataatatagccttttctctctcttgtaggcacccacacccttggagcccaaaaccatgccatgcacatgtaaccaaccagctacatgtgaagatcacataaaggtgttcttgtcctggctctagctaaggttccagctctcagtcagcatcaattgtggaagatgggagtgcatgagcttttagatgatttcagtcccctgcctttgacaccaagtggaactgagatgatctttccaccgagccctagtcaaactgcagattcatgagcaaaataaacaccatcattactgaagcaacatggcatgtggggtgatatgttggggaagccatagataatcagagaaagctccttttctttgtgagcaatattatttgcataggagagagacaaagctgcatggactggaaacttccatgaccaaaaaagatgtcattttctaagggcttgagtgggaggtggccctgacagcatctgcatgagccagagatgcactcacactttcattattgcttgagggtgccaagaactgtagcagtaagagcagaagcagaaatgaagaacacgaaggatgctatggagtgagagaaaagtccatgcttgcaagaatccaaagacaccctgtgaggacgccccaaaatactcgaggaagtgtgtaagtagagctggacctttcattctcccagctggggtagaactggagccatgtgtgcagggcctgcttcttcttcagggctgccgtgtcctggaaagccaagcttgcacatgggttatagcactccactttcccaaagccctcatatacatcatctgtttcagtgctcgcattaacacctgtgaagtagatattattcccaggtctcacagcccataaatggaaactctgccgggaaataagtcctgcttttctctctgtaccagagctgccccagcaaattaaagcttattctaaatgtaggtacctagagcatttcttaaattaaacccagagtgaattctgaacctcagtctaagcctctactgatttgtctattctgtgagttcagagttctgcatagtaaaatctcattaattcaatctccatgaatgtagaatttggggtaggcatcagaaagcagtctctccttagtcacttagccacacttactttggcccaatgacccaaaaatttcttgttaaggcctttctttaaaatgatctctaaggcaggcactttataaatgaaaatcacgcccacctaagcctaggcttgcaggtttgtctgcctcgggctttcaggtatgtctggttctcttaccccatcaaagggacagactgctcacaggtgcttaagatcatcctggcatggacccttgttttatgcaaagtgtgtgccagtgctggatgtgaaaacaccagtcgattcccattcgctggtcttagccagtcagaaccttgcttctgaggcagggtgatactgtggttacttctctcagatttccctctaatgtttggaagttcctatacaccatactgtttttgcattagccacagatgtaggctgcaaatgtctactaggcagcatgggctaaccaaaataaggacacgattgacccaaccttgtcattcttagagacactggaaatctcctcaagttggtaataactagaattttttatcaaataatcactgttttacagataaagatggtgcctccacataaactgaacatatggccggcaaagagcacccctattccatcatccaagttctccttccttagctgaagtgaaaacatttgaaattgatgatacaaagtgctggggagggtggagagaaatggcccctgtctaagctatatggagagtgaatagcaaggcagtttgccaatatctatcacttgttaaatccacatacactttgctccaggaattagaatttcaggaatttatcttaaaactgttgtaacaacacatatatgaagaggtttattgtagccttgcttacagtgactaagtatcagaaacaacctagataactgtcagtgggaactggttgaataatttgttttatcaacatgtaggaaaatatccaatctctatagagaatgaggcaaacttttacaaactttgtaagatgtatttctaagtaaaaataaacataagaacaaacaaatgaaaataacaatgacatgatttagaagagtgtataaaataaaatacaaaagacacacacatacacaactcagcattacagtgaaaattttggaaagataaaatggaaaccattataatggttacagctagtattctggtaaaaaagaaacatattttcaagatactgttcagtaccatttgaagtttttatttatttcatttttaaaccatgtattacattttttaaattaaaagaaagcaaaagctaaaagcaatatgaacacagaaaagtcagtatgaggttgtcgatacgtaaagtttgaaagtgcagacttttcaaaatggcatcacaggaaaactaaggaatatatacattttggacatcaaattgcatcccagcacggagaatatttcttgaagaaagtggctgggtttgatttaaggacttgagggctggggtattttgccacaaaactctatttttttctttcccaaagtgcgtgtgaccctggggttaactacattcaatgttttatcaactcaccctttcatacactctgctatactattttgaaaccaaatttaggctactttgcatcagccagtgaaaagccaatttcaaattgacacatatgttgttgttatctgctggtcaacggttctgttttagcaggttgtcatctttgtttctgtttttgtgatcttgttgcttttatttttgagactattattttgattctgttgcccaaagcttctctagaaaaaaatttcacagggagggagcagctgccaagatccacaccttcttccctccacaccaactcactccatcatcttcaacaactgccaacctattcatcctgcttcagttggaagagctaaactttttgtttatttttggattcaagataaaattttattcaaaagatggaatcctgtaataaaacactcttggaaaataatctttaattgcagtttgcatataatattatttcaaattgaatatgatacagacaaattaaacggctaatgccagtgttaaaaaatgcaagtttcctaaatgtaatgtaattgagataaagacagtatttgttaggcttgcaaagaagagactatttaagtagaagtatgaggtagggctaagcacatggcttttggggccagaatgcctgggcttagaccttagtgctgctaattattggctatgcaaacttgggcaatcatttacacattctgtgctctgcatatatgacatagaaatgttcctggtgctagtgatatcacatagctttgttatgtaatttaatcaattacttgaaggacttagaccatgctcagtgcacagtaagcattatataaatattagctactgtcattacctttaatcaggtgctccttattaggcttaatactatgttcaaaggttaatatgcatgaaatattggaaacatattaatattatttggagttttataatctactttggctttgggggaaatgaatcactcatgatatgaaaatcaataattcaacttctacacatttaaattccatatatattttcaggacacactaaataacacattagaagcctttctgctcaagtatcttagtcattttctagacataatttacatacagtaaagtccacaaatcagttatacagatgcagacacctatgtaaccaccactcagaacacgagagaacatttccagcaaccaagaaggctcccacctgctccttctcaatcaatatccctaaaacagtgaaccctctgacctctaccctttaattagcttttcctgtccttaaggttcatataaatgagctcattcagtgagttctctttgtgtctggctccttttgcttggcaaatctgtgagtcccatcaatgttgtatgatagactacaatcatttgctctattctgttgatggacctttgagttgcttccagtttggggctatttgaattaaacatttttatagatcacgaggtcaggagttcaagaacagcctggccaacatagtgaaaccccgtctctactaaaaatacaaaaattagctggatgtggtgacacgtgcctgtagtcccagctattcaggaggctgaggcaggagaatcgcttaaacccaggaggtggaggttgcagtgagccaagaccacaccattgcactccagcctgggtgacagagtgagactctgtctcaaaaaaacaaaacaaaacaaaacaacatttttgagcatttttgtacgtgtcttctgatgaatacacaacttgcatctcttgaggagggagatttctgaatcataatgtaggcttttgtttagcacaacagcccaccagtttttctttgcatttcgtaaggcaagttgcaccattcttgtcccagattggaggccaacttttcttcagcaatgtggcagggtggcctgtactatgggtgtattagcctgttctcatgctgctaacaaagacatacctgagactgggtaatttataaaggaaagaggtttaattgactcacagctccacatggctggggattctcacaatcatggcggaaggcaaatgaggagcaaagtcatgtcttacatggcagcaggcaagaggccatgtgcaggggaactcccctttataaaaccattggatctcatgagacttattgactatcacaagaatggtgtgggaaagagccacccccatgattcaattacctcccactgggtccttcccatgacacatgggaattatgggagctacaatttaagatgagatttgggtggggacacagccaaaccatatcagtgggcaagttcaataagcaatgaatgcttaagtacccaccagagcactgaagccacagaggtaggaggaccaagaataggcatcttggctggtgacactcagacgtcaagatccaaatctacagtttctatagaggaaagcttccactggcagccaggcccctgccttcagggatgcctcaggccctgagagttcacctctttctcctggcaatgtcaagttccacatttctgagccaggcagaggaaattatttgtgaatttatgacagagaaaatattctttaaacagaatcttccctgattattggagcaaatttggctgctaggaactgcttctccctattagctcattgggaacagaggggagagcctctcactctgcttaaccccctatggctctgttccttgccagagaaggggcccaataaatgcttgacaagttaaatggaaatgatttttccccttttaaatgtctcctcactatggcatgtcatttatacaggacgaagcttttattacattcatcctctttcctcctacctaatcctcttgtctttcatcctccatccacctgtcctattgcatttgggactcaacatgtgacatggaataatagtggttaaagcattagtttaagggccaaaatgcccatgttcaaaccctgttctgccccataatagccactagatctttatcaaataactgtactatatcacaattttttgtgtaaataaataagttaatatatatagaagtgcttagaattatgctgggttaaggcctacataagtgttaccaaatattatgtgagaacctacaggggaaaaaaaagaagggaacctctgtttagccagagttcctcctctatagaggtcttctactctgaaaacatcacccttaattattcccaaaacagtctgcaatagtgaaggataccaaccagtaatccctcatgtctaattatacccttaaaacttgcaagcaccttatattcagaatatatttgaatgcttacagaaaccttttgaaaaagaagaagaggtagtatccctattttgcaggaactaaagttcttgggctttctatcatgcaaccatctaatcactcattcacccattcactgatatagagattgtgttaagcccctcccaatcccagtccccatcccccgcacactgtgtgctacacccagttctcctgcctggtcagccagagcccaggtcttctaatagccatcctgctctagtcctacccaccagaccccagccctctgtgagcttttattcgactactcacttctccatctctcttttctacctcttcctcatccagactttcatcacctgaacatcacattcactgcatttaagttgaatggcttcctaacttaataacttacataaaaattatgcattttattgtatactatgtgtttaatatttagcagaaagaataacagatagaaaaaatgaaagagtaaatgaaaatacagatatacaataaatgaaaaagagagtctatattttaccactctggataattgctatatctctagagcagatatgtatatgtgtatgtataaattttaacaaaattggtattggaatacacataacattttaaaacatacttgtaaactttaatatctatctttccatgtcaatacatatttatcaaccaaatcaattttaattgactggacaatgttgcacagtatagatatccattgcttaatttgacctgttattgaacagtaggttatttccttttatagaaatgttttgctagtataaacaatgctaagataaacatccttgtatatacttttatgttcatatccttaatgatgtactttaaataaattctaactggtgacactgcagtcttatttttaacacttttgatagcttttgtaacactgtccttcagaaagactatgctagtaaaagggtacccaccacatgccagcactagtaagtattatgtaaaacaaataaaaataaaaactaggccaggtgcggtggctcacgcctgtaattccagtactttgggaggccaaggcgagcggatcacgaggtcaagagatcgagatcatcctggccaaaatggtgaaaccccatctctactaaaaatacaaaaattagctgggcctggtggcgcacttgggaggctgaggcaggaaaatcgcttgaacccaggaggcggaggttgcggtgagctgagatcgcaccgttgcactccagcctggagacagggcaagactccatctcaaaataaataaataactaaatataaaataataaaaactttatcagttggatagaaaatgtataatctattttaatttgcattcattttgttaccaatcaaaatgaatatgttttcataatcttattattttgcaagtctttgcccatttctttatatttttatagttgatttataagatctctttttatattgaagataataaacacttatttttcacatatacggctgatactttctccatttgaaaaaaaattttgtgcagccatgcatggtggctcacgcctgtaatcccagcactttgggaagctgaggtgggagacttgcttgagcctaagaattccagaccagcctgggcaacatagcaaaaccctgtttctccaaaaaaaaaaaaaaaaaaaaaaaaaagctgtgcattggggcattgcagtgtgcatgtgtagtgccagcagctacctagggggctgaggtgggagaatcacctgaaccaaggaggtcaagactgcagtgagctgtgatcacagcactgcactccagccttggttacagagtgaaaccttgtctcaaaaaaaaattattttatgtttagttgctaattttaagagacttcaaatatttacgtgtcagttttagtcattatgttttccagcttttgtgaaagacttaataatgtcttttctagcccaagatgtttttatagtttcactttaaaatttaactttttaagatatacataatttatattcttttatagtgagacataaaaagctaacttcttctctgtttgcttagccagttctctctgatctgtggttaaaaatccactgccaggcagagtgtgatggctcatgcctgtaatcccagcactttgggaggatcgcttgagcccacaagttcaagaccagcctgggcaacatagcaagactctgtctctacaaaaataaaaataaaaactagctgggcataagtgtgtgtgtgcctgtagtcccaactactcaggaggctgaggtgagaggattgcttgagccccggagttcaaggctgcactgagcagtgatcatgccactgcactccagcatgggcgatagagaaagtcccggtctcaaaaatgaaaaaaaacaaacaaaaccctttcatataatatcactagttgtttgaatgctggtccatttagcctgtgacagcttggctcctcttatcttcctccttcctgtttctctcatcccttcatcttgggctccctcttcacgtagctttccacctctcctagaaacccttacatgttcaagcctttatgtcactgcatacccaagtccctctgccctgcagtgacttctctccactctcaccctaaccccttctaccaagaaaaccagacatcttttaaggtttacggaaggtgctacctctactctgtgccctttagttctccagatattaacttcctcctcagggttctcacaggaatccatatttctgttggagccttgttctggtgaacagtaattgacagtggactttgggcccttcactagcagttgccctaccatatttatctctataacctcagctctttcggcatacagtaggtggtagaataaagttccttcattgaacaaattaacaatcgactggcatctcaaaaaacctacctgactctataggtagactatagcagggatatttcttggttttcttcccagtatctcattactgggttatccaacagtatgctaaattccaataggggaattcatttttctgccataccctactgtgcatttgaggtgagactgactggcagcccagggtgtctgatgggcttaggacaacctgcctattccatcatggccacagtgatgacttctgaaccgagcatgtaacccaaccagcacctttggcctgagaggatgttttctgagtttgcaaggaaaggatggcttattcctttgtagaatgaaataagaagcccctacctacccaacatgcacacaggacacgagggaggaatgctataagcctcagcagttggtactcttcctcagacctacagaagagcttttcagaaatgttgcccacaataaacaagcagagccaagaaaaactaggcagaaacccagtcgttgttataacatttaagtactggatcatattgcacctgaagtgggtacccctgggctgtttagttacatgaaccactgcattccccttatcaattaagtccatttgagttaacgtttctcttaaatgtaactataacagtcataacatatataaggttattggatggctaaaattacaatgagacatgaaggaaacgtgggcatatcaaaacaaaggatagaggagagaagcaagaaatggtaaattaatgctgcaaatactaatggtgaccatcaccaaaccatgggaactaagatttctaaacagtcttccagataccagatcattgttagcaaagcaatttcctatgtattttattagtttctttgaagtatataaagtttcttgcccagctcttggcacagagtagtcctcaaaacccaataattttcataatcccactttcacccaatccccctcggtcgtaacaatcaacaattcatcttaggataataaaataaccacttgaaagcatgagttattgtctttgactttagagaattcatggagtttaagaaggtgtcagatggaaaaatatagaaagttgactcgttccccagatgaatgcaaaagtgaaacaccaagtgattgtttttagaggaatatgaatcatcacagccctgggagataaagcacagtgcaaaaggaaatgtatccagatcttgccaatattgatattcagccagtaccagacactggggagacagtgatggaaagtcagacattatacctggcctttttgggtacctcatattccagtggagaaaccaaacaataaaactaaatagagtaatttaacttttaataagctgtgtgcctagggctaatttgggaaggtagtcatggaaggcctctcagcatcgaaggcttggcagttgagttataaattatgagaaagggccagccaggcagaggtctggagaagaagaacccaggcacatgtccagcaaatatgaggacttcaactatgaaaggaaagaaagagaggcacaaagtaccataggcatccaaagagggcagacatagccgtttacaacttgcaagggcctggaatgtggttatggtcagaatcctgcaaaggatcaaagctctgggcccccaaggaggggttatgtctgaggctgactaatgtctttaaacctgggccagcagtgaccacagaggaggctgaggccactgacatcggcatgacccaggccggcagatgctgacattcctttactatgtgattcccacagagctggggcttttcatcacgaatgagcattattagtaaccagactcaggggagggagggggacatgtatgcagggagtgagaggcaaagggaaagtgggagaaaaacagggctggacacatcatggtgccagggacccaaggtcaaggggcgagaccctcaggctcgatggcatttggggtgtgggacacttctggctgcagggccctcagctgcctagtttaagactatgggttgtgtttaggggttaccacctcagtctgggaatgtcactgttcccctgagactaatatttctcaagaagctactgtttcagtcactgaagccaacagggtctctacatggggtgaccataggatgtgccacctaaactgggacttttcagggtaatagggagtgggataaattctaaacccaatagaacattgagacaactggcatgaactgggccaactgggatggacggtggccttgctcatacctccctgctcttgcggaggcagtcattgactgacttattaatgtgtgttgggtgttaagaattgcgcacgctcatcttctcctttaagaggtaagcaaatagtagccctgaagagtcaagaatactcaggggctcagtacgaaagcaacatagtattccagttagagtgcaggtgcagatttggatactccttgcctccaatctcactgccactgtttactctgagcaggttgtgttgcctctctgagcctcagtttgcccatgtgcaaaatgggaatgataataataatacttaccttgccaagtattataagcttgaattgaaataatgatgtaaggaggttagcatggtgcctggtgcataataagcagccacaaatggcagttaataggattaattctcagggatggagaaccctctaaaaggttgcatcaggactttgctaaacaggcctctaacagaacctcattctccatcctctgggtgctcctcccagggcctggtgtatgcgtctcctttagaaggaacacacacacattcttctgcccagggcatgtctttccctactttccagaggaaaatgtcctgattcattttccctgtcaggaggctggaaggaacaagcaaaaagaaggagagaattgaggtcattggtccatccacacataagctccaattcagtctttccagggaatcactctggatttactcaccaccaagtgacagatgagagcaacttagtaatttgaaaacctgggaaaataacatgtattctgagatgttcccagtgctggtttggaattactgagcactgttcatttcagccttcagcagatcatgccatcctgagttggagttggcagttctagggaggtcctgagattaacccagagactgagactggactccagggagtcacagcccagttcaggccttagccagggtccagactgtgcttgctgggttttcagcttttccaaaacctgtataaccaatccctgccttgttgtctatcttcgattcttagcaaggttcctgtttcaagatgcaaccacagagtagaatcaatgtaaaaagacatctatacagggagcactgtgaaacacacagagggctacaatctattattgccaggtgctggaagatcaggaagagctaagtagaagaggcatgacatgcaaatagggcctaggaggatgaggatgagtagagagtttaagtaagagtggaaaggaaggacattgaaaacacaggaacacgatgcacacaggtaggaagacaaggtggtgttggcagatagatcatatatacatgggtaatgcctgggagcaggcttaggaaaaagcactgcctcaatttgttctcttattaattagtctagtgtctttcttagtcacagactgtgatatccagggtccaagatgacctctaatgatctcctcctcctggttttcttgtctttgtgtggtccttactcccacttaatagggctgaccatgagccaatacgatgttgtcaaaattaaggtgtgacttccaagtctagatcatacgatatgtttccactttgctctctcttggctcctagctgtgggtaaagacagctaccctatcattaggacactcaagcaaccctacggagaagactatgtggtgaggaactgaggcctcctgccaataaccagtaccaacttgccaggcatgagacaccttgggagtggattttgcagatcaggcatgtcttatatgaaggcacacctggccaatagcccatttgttgcttcaacagccaaaaccacccagctaagctgctcctggattcctgactcctggaaactacatgccagtaaattacctttactttaaactctaaatcagaatagactatgttgtgcctttttttcttggagcttccacacaaagggatcttcatcatggactgttttgccacaataaacagaagatctcctggggcatattaaagggaaatgtgtccttagataacctggaagctagatgtttgtcaatgtggcttcatgtggttgctttcctctgcacacattctgcattctcctctatgcagctcacttcctttgtacggctgtaagtttccatttacctagaacttgcatttgcctatggtttgtggtggcaaccctggctctaaccttacatgacgttattgatccagagtcaatctcaatcttaccacatgttttgtgagcttactttatattttcaagaacgaggatgattggctcctcttgagtcaagtacctgcccatgaactcttcaggtaggaccaaggagcagtcacccagtatacacatggctccttagcttccttctttaggaatggactggaagaatcatgaccaaatgaagggttatagatctggccagcacttcaaacattgccatgtgtagtacatgtagccccaactaagaacttcccagaaaacctgctgcaagatcaagatcaaacactctctccatttttatgaacacactagggtgtgaaactttctctcccgaataagaagaaacttgaaacaaaatcctgttggtagccaggcattaggattcatgactcaagacccacatttttacaaaagcaattccaaactctcaaaatcaattatgcatcatattatatcctcagaataaaataaatatacatcccagaattaatatgaaggcataaacaactgctgacagcctataaattgtattaggaaaactttgataaactcttacttttccacacttccctcaacctcatgacaataactgtttagattcaacacatatcaggggcatatgcagctggaagtaaggagagttggaaataaataaaaaggaaaacagcaagagcaggagaaatgagcagaaggttaatgactttaaaggggaaaaggtcacaagaagaagtgaatctgatagccctggaaaacaccctttttcctttctgataaaggaaggtagctaggagtgtctttatgaatttacttttcatgctttccctctggtccttagcaaagagggggaaattcagaatgagctattatttactcaagaaatagttactggacatctgaaggtgtcagaggcgttcgaaccagagcaactccatcttgagtgagggctaggaaaatgaggctgggacctgctgagttgcatttccagaaaggtattcctagcctctagatatttacacttaagggaacagattgataatgtttactaaacagatccagacttgggactctccgaatatcccgatatcttgagaacaaaggcattcctaattttgctttaaagataataatattggccagacgtggtggctcatgtctgtaatcccagcactttgggaggctgaggtgggtgggtcacttgaggtcgggagttcgagaccagcctggccagcatggtgaaaccccatctgtactaaaaatacaaaaaaaaaaaaaaaaaaaaaattagccagtgatggtggcacatgcctgtagtcccagctatctgggaggatgaggcaggagaatcagttgaacccaggaggcagaggttgcagtgagctaagatcatgccattgcactccagcctgagcaacacaacaaaactccatctcaaaataataataataatattgattcttgcaaaatatagtaattaagaaaaccaatcctttgtcacaaaccctgtagcagagcacgtctcccagtgatcttctcttatcctgtatataaacaagcattgtacctagggtggacatattcctcctcttactttcaggaacgtcctagtctgtctatggagtagctgttctttcatcactttactttctcaataaatgtgctttctctttgcactgcggacttgccctgaattctttcttgagtgagattcaagaaccctttcttggggtctggatcgggacccctttcctgtaacagagggactaaatggagtcatgatctcaggcaacttaaaaaaaaatacaggagacagttgaacaaacaattgaagaaaaataggttcattgctatatcatgggcattgtacaaaattaattatgtgtccaggaaggtggggggattgagctcctcactctgttgaatgggttcatggaaagggcagtattatgggttgaattgtatctctcccccaaaagtcctaactaaccctcagtacctcataatgtgaccttacttggaaatagggtcattgcagatgtaattagttaggttaggataaggttattagggccctaattcaataggactggtatgtttatacaaagggggaaatttgaacacagagacatgcacacagggagaatggcatgtgaaaatgaaggcagaatcagggtgatgcttccacaagccaaataaccctaaagatcatcagcaaaccaccagaagctaggggagaggcacgaagagattcttcctcaaccttcagaaggaaccaaccatgctgactaacaccttcattttgcatgtccagcctctagaaatatgaaaggataaatttctgttgtgtaagccacccagtttgtgacacttagctatggcagccctagcaaaagaatacaaacattttatagtttctaaagattaagagaagactaacctgctaaagattaaccttcaggctgagggggccagaatagggcttcagtcacttgaggagggtagactttgggaatatgagaaaatgcctcatgttgtaggagtgcacgttagagagggatgcaaagtgtggctgtagagaaagagaaagggaatgaattgcgaaggcacgtgttgggatgttgcaacatttttaaaggaaagctggggaaaagagaggtattgaggcatcggaatcacgtgagggctgctctgtgataagtctacagtatacctggtaataacagatatccaaaagctatttgttgaatgaatcaagaagaattggctacttcagtgcaaataatcaagccatgggacatccagcatcaggctctaccacatagcctattgcatgagtgttccaggtgtttcgtagtcccctggtgaaagaagagccccaaaggcaagacactcattttccctgaaatgaaaaggtcagccctagcaaaggggaggaagtgttccttgtacctctgtcttccccatgcttccctgcctttccacctaactcgctcatcgaatgtcgtttaggaaccatgggttgccaaatttctctttaacctgaattatatgtttggagacagaaagtgtaagatggactgagaagccaggagtagtaaccagtaggtggagagatagtgaccagcccctggaccccttcagaggacttgccccacctctgaactgctctttctgaaacatcttgctttctgcacaaatcatgttgtgggtcgtggtgggagccagaggggggcagccttgcagcaaaatgcctggaggctgcattaacttctttccctgacaacttatatggcagctaatttatatgctacctcctattagtttgggggaaaaatatagctaacgataacgaagagaatgccatctatttctttagcttaaacatgcctgcttcagtggtgaacagttgatctctaagcttgctgttttcaggctataaaagctgtttatttcactctataaaagaacatttgaacttatatagctatttaagtttaaatgttttaggggaaagaaaaatgcaaggggaattagcaaagagaggctgaaacctgatctgggctgcggggtttgcatagaaacttccctctttgggaatcccccctgcctgcccccagtacacccactgcagcaccagcccacaggaaatgtactgagctgagtgtgatttcaacattagtagtcatttcggcaaagctctcagagtcaatcatttctcatgcgctggtgtgatttgcattcactggggaccccttggctcttaaaaagctgcagctgccccaaagaggtgaaggacattaacaaatctttgttgtttttctcttaaaaactgtgagtttgcatgagggatctgggtagaaatgtgcttctctgtgcatcatgggaggctgctgctctgttggctctgagaatgacagataagtcttgagtttttgacaaataagctgctttctcttgaggagtgctcagacttccagttagccaccagaatgctggcctttatgtctttctggaagagttaaacattctccaaacaggctgaccatgcatcttagtttgcccaatacaatcccagttcatgcctgttgtgttcttggtgtatgttcaatggtgcttccttcacccttcagaatgtcctgcttcagatcataccttatatgacaaatctattcctggaagtcttttcttgcattttaggccacatttgcacccaatttggggagatacaagtgctttgggatacagatgagtttgagaggtgagttctcttggtttgggttcccataagatcagctctgagtcaattgtgtgcaagtagcgtatttgggaggtgcagaaaacacctgttggcaaacagggatataagaataaaaggacagcaactaaaataggtgccctggacatctggaacttaattctgctgaggacactctggcagacaaagaatgccatagaatcatttctcatggtgggtgaagataatcccaggggtgttatttccattacttcctgtctgcctgctagagggcaaagcagccttcagctgctttggagaaaagctacaactataggaaagaaggatgaaatggagaaagaaaacacaagtgttatcgagtatccaaatgtttcccaatctttctaggcttagcttaattgatacatatgctccttcagcagggtcatcttcataatgaaattattttaagtgcaattgtttaatgtatgtctcacctgccaaactatgatcttcatgagggcaggactgcataggttttcttcaatatgttctttgaacatagtatgataatatttgtcaaatgcatcaataaataaataaattgtgtcagttgtgtcatatactccatcactcaatgttttccattctatgacgtaacgattataatctccaatttgtaggcaagaaaacaagaagacttctcaatattatgttgttaggaaatacaaatctaggtctgtcttactaattccaccctcttccagtatagtcttctggtaaagaggagtattgataaataaagatgttcccacttttttttttttttttttgagacagggtcttgctctctcacctgggctagagtgcagtggagcaattatagctcactgaagccttgaactcctgggctcatgcagtcatcttgccttggtctcccaagcagctgggacgtgtagcatgccacagtgcctggctaatttaaaaaatgtttttgtagagatagggtcttgctatgttgcccaggctggccttgaactcctggcctcaagcaatcctcccacctcagcctcccaaagcacttggattacaggcatgagccactgcgcccagccaagaacttcccattcttgcaggcctctttgcatctcagcatgttgtgttctacaaccacacatgctgcctaatcctagtctgccacttcatatactcttggcccttctccaatttaccctcctattttagggtgtcagactcaagcctgctgtaattgtttaaagacttaacatggaaaaggataatgttttgtttgttttaatcttcaggcaagggagaaaaagccaaagtttcagaagctagtgcttgcctttcccacgaatgattctgctcctgaaaaaaaaggaaaggcacttaaggatttctgacatcatttttttcccttcttcattgtcaaaagtctggtcaaggtttgatggggggcggggtgaagtgaggtgggagagtcgagcgctgtgctggtaaatgttcaaaaaccagctcccctggaacaaactttcatttgtagcatatgccactttccatggtgtgaacttaaaattgaccactgtggccaattttaagctatcaatgttgaatcactgaatgtgaatgttgagaatggacccacagtactacaacattatatagcatttccatcacatggatataatagatgtaaacaacctcacaagcatggattgcagtacaataattgaaaatagtgaattttgagtatttacttattaccttttaaaatgcagtttattagcttaaagtttattaatgtaatttttattaacagctgcatctaacaactagaacacaaaatttctgtaagtttaatcgtcagctcacatgggctgctacagctacaccattttagagactctctcttgagtaagtcctttagtttgtagattctattcagatctttgtcctaacttcaaatgagtgagatctccaggtgaaattggccaatggaaagtggttcaagattatggctggacaactggagagtgaaccatcttttgatgctctcaaagtttgagacactttgtgtgtgagatattaggcttgccactaccctcctccctaatgaattattggccttttgtgaccctgtgtctctggaggctgactcctaaggagtgcactgctcaaggtcctttgaccttttgcttcttgctaagctcagaaaaaaaaaaaaaaaaaaaaagaggcactggcaagatacatgaaataagaaggagagagaattgggagtatatatacccctactctctccctgcctcactgcagttctgacattagctaaaaaggctcctcttaggtgggcatgttccatggctctcactagaccagtcccagttccctccccttggctttctctatagctgcttcctgggtgccccaccaactttcagtccacacctctgtaaacagtccctttattaaattctttccagctaaacagttttgagtgtgccttgtttgatagaagcaccctatatgatataccaagtgcatatatccagagtaatatatccaactgcattggtctttaggaaacctaataacctaattgctcatatggggagcacatttctacgttatattctattatgctcaccctgtcacgtccatactattatcaatgtccagttatcaatgatcagtgggaaaaggggacacagacaattagctttccaaatatagggctttcttaactcccacatgcaacttcatccacccagtgagcacaccatcaactcaccttgactggttggctgaaagtggctcatgctttgctttgagaaccaggatttggctctaatattaggcacagcctgtcctgtgggacttgtaatgaaaccaggcagctgctagggctctctcttatagtccctatcttgttcatctggcacaacagctatttctgaattctgcattttgtattcttcttatggacacctttctctggcctgacattcttcttggtctattgtcccagacccacgcacgaattcagttgtcaaaacatctaggagccaatgctaggtcattaaactaacataaattgagaccatgcaccagttacacactcaactcatattagcacagtgctaagaagttcacacatacagcctcttctaccatggtaaaaacccaacgagatgggtaccatttatcccacttctccaacctattacctactgcttgtgctggtcatttgtctgcactcggatatattccttacccttctttccatcttctctgtattataggaaactacatttacaggctcccttgaccactagtttctggctagatatggcctactgaaggacttggcaagacacaggacaggaaaaggccagggtaattttcttcctctcccacctggggcagcatctctggaagcaactgtgcttctcttgcagctcccactctcactggacagcgtatgccttgatggcctagcaggcctaccacagtcccagtttccacagggctcttgggatcctgcaaaactgctttcttcttttgtccctccagccctagataaggcactcactttctacagttgctaatttcttgcttcatctcctcttcactgttttagttcttcttataccttaaaactaattccctacattaaattttctctattgaagtactttgcacgtgttttgctttcctggctgcacttgactggtgagtttctctatcccttgtcttctataatcatatttctatagctctgtgtgtatgtgggtgtgtgtttaatttattgaaagcatcctgtactataactatttgttccctttatagtattaactagaaatttctatctataactacttacattaataacagtttatgcccttttacctgtttattgtctgccttccctgatagcctgtaagctctatgaagtcaagcatttcacatattttattcattgatgtatttgcaacactcaatagatgactgacttgtgggtaatcatattaaataaatgagtgaaaacattaatgaatccccattttacatataaacacactcaagcctaaagaggtgaaataatgtttagatcatctgattttgtgctgccaggtagctcagtgaactgcctcctttatgccacctgctttttttctatggatttagaattgtggcccagatttcctatggtagcagccatcttatttcaccttggatctcccaatcccattgtccctgtttctccagcaccactgtgtacctgctctaaacatagcctgctgttgtgtcatccctgtcatactaggctgtttatgcttccttccatggcaccatgagccatattttccaatatttctcccagtcctggggtggtccacatttcattccagcctggatccctgactttcataagagtacttatgaaactgcatgccaacatttcctaacaacgtataacatctggtggaactgaggaactcaggcccacacctaaaatagggggtttccccaaataacctagcctgagctgagtctggcctgagctccctgctagtgttgccagagaaaatataaaatacccaattgaatttgaatttcagaaaacaatatatatatatatatatactggtactgaaaaagtatttgttgttcatctgaaattcaaatccaactggacaccctgtatttttgattgctacatctggcaaccctactgtctacagttgtcaaatagtgggagagctgaaacattaactaagactatgttcctttccaagagaacttttgaaaattatcagaatctcccaaagagatgtaaaaaaacagatccccaagtccaatcccagacctgtttgttggataagacctcggatctgcttctttaaaagcgtctcttgcattctgtgagtcaagcaggctttatgacaactctgattgttgccataacagaagcaatgagagaaatcagtggatgcagatataagtgaaaacaaaacagaacaagagttttaggtgacaccagaaatcaggctatctgattctcaaatattgtgctcctctgaagcagaagggagggactgcctgtgcccagaactgttgaccgatcgtgtcctggagactacttcctgtccttgttctccatccttgcctcctcagcactctggatggcggaggtcccgacagtaaccaggcaactctagagtctggcctgagctgcctgctagggttgccagagaaaatataaaatacccgaatcaatttgaatttcagataaacaatatctatgtatatgctggtactgaaaaagtatttgttgtttatctgaaattcaaatccaactggacaccctgtattttttattgctatatctggcaaacctatctacagttgtcaaatactgggaaggctgaagcgttaactaaaactatgttcctttccaagaggacttttttcttttgtaaaataattttcaaattttattttagattcaggggatacatgtgcaggtttgttgtgtgggtatattgtgtgatgctgaggtttgaggtacgaatcatcccattacccagatagtgagcacagtatgcaataggcaggtttttagcccttgtcctcctccctctcttcttctctagtggaccccagtgcctattgtttctatttttatgtccatatgtgcccaatacttagctcccacttagaagtgagaatgtccgctgcttgtttttcttttcctgtgttaattcgattggaatgttggtctccagctgcatgtgctgctgtaaaaggcatgattttattcttttttatggctgcatagtattccatggcatatatatataatatacatataatatatatataatatatatacctataatatatataatatataatatatatatacctataatatatataatatatatattataggtatatatatatatatatatatatatatatggcattttctttatccatcaaggtacccttgatgggcacgtagggcacgtaggttaattccatgtctttgctattgtgaatagtgttgctatgaacatgggagtgtatttgtgttttgttttttttttttttttttttgtagaactatttattttcctttggttgtatacccagtcataggattgctgggttgaatggtagttctgttttaagttctctgagaaatctccaaattgctttctacagtggctgaacttttctatttctaccaatagtgtataagcattcactttttctgtagccttaccagcaactgttattgttttactttttagcaatagccattctgactgctgtgaaatcatatctcgttttggttttgatttgcatttctctgatgattagtgatgtaaagcattttttatgtttattggccatttttatgtcttcttttgataaatatctgtttatgttctttgcccatttttacattttgttgttgttgtttgttttttgagttgttttaagttacttatagattctggatattagacctttgtcagatgtgtagtttctgaacatattctcccattctatgggttgtttgtttactctgttgatagtttcttttgctgtgcagaagatttttagtttaattaggtcccattggtcaatttttatttttgttgcactttcttttggggacttagtcataaactctttgataacgctgatgtaagaggacattttgaacttctgtttcttcgagtcgcataaagccagtgatgttgaggaagtccctctttaataaacattgtcttctacaagacttattctttgacagattcaattctgcacacatgtagtatttagtacctatttctgtctgccgtatgggttccaagtctatccccaacatgatagtggcaaatgctcagtgttctaggatgactttggcaagaagttccatctaattagaagaccagcatcaatatagctaaaccagctcaattgttttaggtatataatttgtcttccaattttgattactgcaaatatgtttaccaaatttgtttaagggcatatcctgccttattttgcatttctcatagatacatgttaaacatggaatttaatacataaaaatggtaggatatgccctttccatgagtgatgggattgtttagtattcttggggaagtctctgtgtttgtcctttatttattcatttaatatatcttttttgagagtatattatgtgctacgtggtgttctaggtgttgggaataatgaagtgaaacaaaacaaaacacagccttaaggagtttgtgctatggataaaatgagaaagaagcgggcaggatgggcctctggggaggtaatgtggctgcaattttaaaatattcgttaagaaagacctcactgaagaggtgacatttaagcagcaatttgaaggagaactgcttttaggattttaagaactctttagtgaatttgtttaatcgtcgctcattttaaagtgtatacatttacctaaaatggagtactcatagcaagtctatcatttatcaggacatcaaatttgtaaggtgatattggaatgcaatgtgcttaatgtaaatatccactcttcaatctcaaatggaccaactcagaaaaacacagtgcattacagttgtttctaattaatatttgttcatgcagtatagtgcttaaagtgtaggttctgcagtgcaactgcttggtttcaaattctgtccccaccacttagtaataatattgtgtatgacagattgttataaatttctgtacctcagtttcctaatgttacattgggataactgtattagttacctcagagtgttattgtgaagattgaaccagacaatgtacaattcctatcccagagaaagttcttcatggtatgctaataagctggctctccagaagaaaaacaaaaagccctgatatagagtttgccaatgttcatggcataaaagtctcaccttagtcaatttcaagctcagtacattgtcactgaacatagagttgggaagacatgcacacagtcagctacaatgagctataacactgtactgactatataacacactaaatacatgattcatggtgccatattatcaaagataagtatttatttgtaggaaaataatggtcttaagaatgtatctttatgtacatatattgatggctttagagcagactttctcaaccttggcactgttgacaatttgggtttgatttttttttaaattgagaagctgtcttgtgcattatagaatgtttaacagattccctgacttctattcattagatgccaggaactaccctcctgccctagttgtgacaaccaaacatgtctccagacattgccagatgtcacctgagggcagggaggaattccctggttgagaaccactgctttatagaaatggtagccagaaaagctagaaaaacatgtttctagaggaatagatttaaaatcacattttaaaagaaagtaacaacaatacaagtgattacaaatacactgaaaagcgtatcagtttttcagtaattgatatttttaagaagatgagcaatgggttaacactaggtggaaaggtgggctaagatgtcacaggtggcaagcatcatggcagagtggctggagcctgttggtgtcagataggcctcggctcttacctggactctgctccttatttgctgtgtgattctgggcaagtcacttaaccactcagagcctcaggatcctcattaatggaaaaagaatgaagactgactgaaacagattgcaaacataataatcaagtcttataagtatttattgaagaggaaagaaaagggtccttgttagctctgtgttttgggggactggtaggccttgggcaaggactgatggcaggggaagcccaaaaggtgtggtggactggaaagcacaaaatgataaagtgcctgccccgtcacacacggctgcgggtcactgcttggaaatgtgagaacaaaatgggaccccaagctaatgactttcaggtgtgctggcccggctgcctggtcattggggaatgacatagaggccaaggctaatgctccggggctgccaaggcaaacatccagacccagggcaaatcaaccagagccagggacttggggcctctcatcgcactgcacagcaccctgtggctgcctgggcctgcacctgcccactgcagacacagcaggcactgcacccttgcctctctcactgcaggcctgccgtccttgctcccagatgtccccattgccctgctacctgcccaacccagcactggcactactgttctctctttttcaatcccaaccttgtgaaactccagtgaaaattctgctgattggaacgatgcctgagtcagtgcactttagctatgtggacagagaattccttctttcttcctgcctaccctttgtttgctctattctttgaactttgcacagtgctccactccaggcatcactagtgtttcttggtgtccccttcttccttccatcacccagctacggagatggacccaacctatgatgcatttcatacaagctcttttctgctcacacaacactctctgatgagccatgggacagactgaatgtcacatttgtagcatcagttactccaaaggacatgatggaaggtagccaggtgggtaagcatgcaagtggacagcatcagctgggttcagggatgcttactgataccacacaaattctaccttgcaggcccctgaccctaggcttgcagaaggattcgctctgacttcacaaacaagactgttgtgaaagtatttttgttctgggacttaccgtcatgggtcagaatctagatgctgctgcttatttaatagctatgcaaacattattaaactctctatgtctcagttttccaaactgtcaaactcttttttatgactgttgggaagataactgagactattctttcacttaacaagtatttactaagcattgatgatggtctggaagcagtgctagaccctggaccttagggatacagatatgaatacagcatagtctctggtctccaggagccacagtctaggagtaaaggcagatgaaaaactatagcaagatgaaacattatgtgtgtgtatagtacacataactgataagagtcaagtcttcctggaatacaccattcataatccttcagggccttggcacttattgttgcctctgccctcaaacttgcctcccagatatctgccaagtttgctccctaactttcttcaggtctttgctcaaatggcattttgtcataggcatcttccctttccaccttatgtaaaataacatccactctcttggggtctattcccatatctgttttcttcctagccatatcatcacctgatatactgtctttctttttccttcccttccctgctctagaatgtgaactccatgtgggcaggagcgttgttttattcactgctgtaactcaagcaactgcaactatgtttgtaatgtaattaaatgttacaataaatatttgctgactgactgaacaaataaacagaaaaatgagtgaaaattggaatgacagaataaaagacataattcttactgggagagtctcaaagaaaaaaacccttgagagggacctgcagatgtcagagttacttgaataatacagggaacagatgagggaagagaatgtgcaaaggacatttagaaagtcatggtctgttctagaagcagctgttatttgttagtaactagagagatgaagataggctcagaggcatggcaggaaatgcatgtggagagtgagatggcaacaaatctcatttaatcccttctaagaagagtgtacttggcatgcaacctagaacttaattttatttttaaaaactaacacagcaacaggcacatagaagatgcccaatgcttttcgagcgtatgctttccatatatcagtctgtgagaagtgcatagaaatctctaaggtggactattctactgaccccagctagcctcctatcccctgaacacagataagggctttatggcaggtaagacctggggtaattggtgtttggagggcaccacaccacaggctgtgtaggtcagcattagtatacaacttatggaaatgtttgccccttctcagaatccaggcaaggccagcctaccccagtccaaccattcatcccaattttaaactctccatttcaaaagtgctgttccataaagtgttgataaattagggcttaattatcccagctccagttccactatgctctggttacagtaaataaaccagtgcctgtttaagtagatttttataatggggcaaactcttgtgtagactttttactgaaacagaatcactgctttgaagagagcccaagtttcatagaagaggcttgtggcaacttctccctggctctgcagatgtgcttggagaaaaaaggaagctgaatactcaggctggactaaaatgagggaggccacaaaggaactctgtgaagtcagcagtattgattcttactctagtttctcacacatgtctaaagttttaaagagatcatagtctaagaggaattgaagagccatattgtttttgaaatgcatttttaaattttttaatgatagttgagaagtaaatgaatgcaattgctgtggtgtggaagcatggtgtgaggtaggggtgtgtgtgtgtgtgtgtgtgtaaattgaataattataaactttggtgaatgaccttttaggttatctcaattgtaggtggcattacaatttactcataattttaaggcctcattacatctcacccagagcaatggcctcttaattaatttttttgcctccaagttcacccaggtacaatgcactcttcatatcaccatcagccaaatatttccaatatacaaattgaataatgtcacactcttgtgcaaaacccctttaatataagccactgtcctacagaataatgtccaaactccttgacctggaatttagaggtcccttccaagtagtatctggctatcttgccatttgctatgtttcaaatgatggaaatcaccagggccctgctatattactgtcttcctgcttgtcaataaaaaattactaagcaccatcagtaaatatttctttattgaaaaaataaagataatttgaaggaggtacacaaatacaaacatctatttatgttctctcccttttatccctttcttttttatggctccaacatttttacaaatacataacttctatgatgggacccatgtgctcataaattaagattagaatgagaagcattgaaagggtgaataagccaagtctaccttttatttaaggggcaagcatttgcagagacattggtcaatgcattgtaaagaaatgactatgtcctccttagaaaattctgaaatggctaatcaagagacccaggctggatgagtgatgggaccttgcctcactcagctgaggagaaaggaaggactcctggtgctctcatccccacagatctcccctggcaccatcatgaccctggttacaccaacctccatgtgccacctccatcagaaaaaaggttttagtagcagcctactcttgacaatgactgatgaccagcatgctttgggttccattgaaaagccagcttatgtgacaggcatcactgtacttactgcaaaggaaaattatgccatttcagagaaccaggaggaacacagcgattgtacattgtccagtgattttcctatctaagaggcaaaataaattttctatctggaataaatattttggaaaatagctggtccgtgttttaattggcctggatcctagtagtctgagatgcactgaggccatttgattcactaaaatgttgaaataattgagattcctcaataattttgaggggtaataaaagcaagagataccttcaaatcaaccctagatgagagctgagacctgttcccctcttgttccaatctaagggctggacatacctcaaaatctgaggatgggaggattacctacaatgggttgagattctgggaagaggactagaattctatgtaatcactgggctgggccattcatttgggagccagaaacaagaaaatccagctgtgggagtgtagataaaatcaggatttggattcaggtcttcttcatttcacatcagcatgtatgtacgttgtaccctggtcccttccttaattccacgttgctagtgtttactgcatgtggccatatcaaaaggactcattcatgttctgtgtctggcacaccatacccaatcatgactctggaggttgtgtctctctgcctttggttgattttaatatgacatgaggtcctggaagtccctcttattcattttatttatttattttaatggcctaaattcaactccactaagcaaatcaattcagcactgaggctgaaatttacaatacggccaccaatactatggctcaacaggatgcattaagaggctagttaaacaccaaatgcagtataaatctcagccttataggtgtgctgaaaacataaatagcttccaaagagccatgatcaataccaagatatatgtgcaggctccaagtgtgcaaataatttaaattttaaattagcccctccttagtattcccaaatatcctagactttgcaatttctgttaatgatgccaaatttccagtatctaatcattggtttttgagtttctattaaaatatccaaactgggactggggtggcatcatgcactgtgtgtttattggaatccagagatgggaaatgagaaagacataaagaagcgagttacagagaataagacaaagggtgggcatccaggaaggtacaaataggtggcacaggagaaagggcaggtagcaagttggtattaagaaagtctggaagcaggtagaaggtgccaggtcatatgaaaaatgtgttttggcaataccttaatggtgctgggttggccttgttatggaaaaccatggattctgagcaaggaaacaaagtgagaatctcaccatgtgaacaccagacatagctgcaagaaagaaacggcatcagaaatgatgcagacccaataccactgccaagtcataaagaaatcgtttgcctgatgctggtgttggctttgaggctgaggctggctgagcctgcaggagtgagccatgggtactcagaaggctgcaggcatggggttaagtggggaagcgacattctctcctctttagtccctacacctctgccttctctggaagcattatcctaattttccccaaatcattcactctgggcagaggccagattgcaaatacctgggcatgaaactatcctttacctgggtaatttcaggggtaggagatcttaatttactttcattttcttctagatcacctcacctagtgggccagagagttgggcgacctggtttccaatccccactctgctgctcactagcagtgctaccctgggcaagttactcgacctccaaaaacttccatttcctcattcataaaataggagtaacaattaaacctacatcattgagttaatggaaggattaaattaccgaaaggcatttatcctggcccataacaatttctacactcactcttatattcagcaaatatttattgggcacaccataggaaacagacacatttttaacactgagaatacagtagagaagagtaacaagtccctgctttcataaaacttttattctagttgaggaagaaaataataagcaaagacaaaagatgtgatatgtcaggtgataaaggttatgaggaaaaaataaaataggctaaagcaatagagagtaatgggagtgctctttcagctaaagcagctaaagcctttatggaggaggagatgtttgagcagagatgtgagtaagtgtgggagtaagctatgcacacttgtgcaggaagaggcttccaggcagaggaaacagatgtgcaaaggtcctgaggcagatatgtgctttcagtatgcaaagatgaagcagcaagaagactggaggggctgaaacataggcagagaggagggagtggtacctgctgagcgagagcaggtgtcctaggcagccatgataaggactttggatgttattctgaaggagatggatgagaaatcatccgaggagtctgaaaagagcagctccacgacctgacttacagtttgtaggagtagccctggccactgtgtaggtaaaaatggggcctctaaggagctcaccgtagttatccaggggaaagatgatgaggatagtaacaaccctgcctcatatgaatgtcactgggacaagttaaggtcacaggagatggtgtcgtcctatgtccatcataggaactctcttattatttctctgtctctccttttgcccctgtacatatgcaggattcctgccccagccttcccagtccttgtataagaagcactctgctgctgtccacctgcagagccagtgctctgacatcagggaatcagttcagccttaggaactggtccctgtgtgctggtgctaattactggagatgtggattccaaaatgcagtgtatcctgaaagtcttgggcccaaatgcaaaagcttctccttatctatggagcacctttctgcccattctccttattgcccctggcctattcacttggtggtcagactgaccttacttgtggcctgaaattccagagagaaggcagcagggagaggctatttttgatgtttattaattctcaaaatgctgggttttgagaccccactacccctacctcaaaggtgatgccacggacaaatcaaattaacaaacaaaggaaaaggtagagacgggtgtgttctaaagacaatattctctgagaagatgataggcaggctctagactcatcctttaggctgcctccctgacctctctggtacccatacttttggtcataagctgtctccatcttcacaggtttgctgcaacagaaaggggctcatgtcaacttcctcaacacctcctgagactgttaaacagctggcaggaatatgagaacaggtccattctcatgaggttcactagatttacttgtttgttgctctaagaagccatcactcaaatttctgcaatgcaactagttaacgtgtccttccatacagctttctgaatatcccccagcctttctccctctgctcccaatgccctggtgaagatgtggccttattatctctggaataggttaaggtaccagcctcctgaatgttccacctgccatcactcttgccccctttccaatccaaacctgagcaagtgctcttcccacttctccccactttttttttttttaattttccaagggccttggaagaaagtgcagctgtgtgacttgtcttgcatgtcaccactctactgtgagacattctgcagtcccactagaatcttcagctccctggagaacgctgcccccatgtacacttccatacctttacacatgccctctctcctgtcatttttatgacctagcatccaattcaaaagtcattctttccataaagttttatatcagtatcccagaaagtgagattgctcactcctccaggtaccccattcatttttttaccttcatttcagatatcccaaattattttctaattatctctgtgtgtggcattctccttcactggtgcatcaattctttgagggcagtgactctttcatgctgccatgcactaagcatttggtattgttgatttcatcctaagtagatctagaaagatctgaggagaagagggtataacgacacagtgagtcacacctgcagtagggaaagaaaatcccaaagcacatgataataatgtttgcaagtttttccttaatctttcatgtatgtaaagtgtgtcgcagatatggactcacttgcccttcacataagtcccatggggaaggcatttttattcctgttttgcagatgccaaactgagtcttacgtagaggggctaactgaattgcccagtgtctcacaagtcaagtgtggtgtgggagccagaattcaaagttcactccatcccacttcaacacatgagttcttagtcactatagaaatgtgccctctcgcactgggagatgttgacctgttggcctatgtatgatgagctctgaggttgggcttgcaatgacttgaggaattatgtcgaagcgactgcagcagaggctacaaagtgtctgcctctgatagggtttgcagacttgcttctctgggttgtcaaccatttaaagcacaaaatgaggaagacttacatggcttggcccagtactttgtctataatcccaaattatacttagcaacctcaccatccaagccagagtcctttctttagagttttcaggcacaaaaggaatcatgattaatcagtaatcattatcaacgcttaattttgccctggtcctgatttgggggcaattatttgtggttgaaagtagtaagcagaggcaaagtgagcaaagataaagtcaccaaggttctttgagcagtttatggacttctttttctcaggaagcccttcaagaaaagcattctatagtccactcagaacttcttttgaccctcacgtatgtattcaaaaaacactcattgataccaaatcctgttatagacactatagctatggtgacaagcaagataaattatgaaatgcttattatacagggagagacaaaaatataacccagtaaaaattatgaaatataaaataattttgcattgcaatacgtattatcaaaaatatttaataggaggtagggagagaaaataatgaggattgcttgactttctatagtgcattcaagggagtcttcttggaggaagggtcatttaaatggaagcctgaagatagaacagaagtcgggtatttgaggattgcgggaaagagggctcaagatatggggagccagaaacagggatggaggctgcggaattaaggagcttgtgtacgtctggagtgcacaagatgaggatggtagtaacactgtctccaaaatttaattttgaatactatggttatgcatcctgagtgatccaggaaaattgccttctttctcttctcctcaatctctaagtacctaaactaagcctcctcctcttgcaacgttttatctctggtgttcatgggagttgagaacacaccattggagaatttcctcagttcaaagacaccagatcaacaaaacaatctggatgttaaccctgaagccagcctacaataatcagggcttctggctcaggttcacaatgagcaggagacctctgccacctccagtgctacctctttgtaaaacctcaacaagctattttatgtgaaaatattaatcactgctcattgcagcgttcaaaatcagtcaaggaagcctctttgaaggtggtgacgtaggggtttatataagggatcagctgatggaaaggagaaagatgcgcgttccagagagaagaaacaagctgggtagttttgcaaatggtttatgcccatgtggagacacgccaggttagagcaggtctgtgtgggagagaagttgtggttaggggcatggaattggacagagaccaaaaacatgggtcctagaaagtcaaattggaggactttcatcctgcaactccaccctttcctctctttttttcttcgaaattaaccggacttatttcttattctcctcatgggagatttcacagctattatttccattttctcaatagctttgggaggtataattatccccatttactagctaaggaaactaaggcttaggagggttcactgacaggagcgggagcagcttgggctcatgtcacgtgtcttcatagtcagcacatagcttcatctgtcctatcctgcacctgctgtgtcttactgcatttagattgcagccagctttctctctgtctctttgaatttcagcacaggtaggtactgcacttacccattcttatagatggcaaaccgaggctcagagatgttaaaccactcctccaatgtcacattgctaggaagtcgccaacacattactaaacctggggacatctgctcttcagggcagcactccgttgcctcccaatacccagtagctgtgattgttagatgatgatgatgattattaatagagttattgcttttggggcaacactagcagtgcagcagcgagcaggctagcagggcccagggcagcttgctcggccacatctgccctggagctgctgtctgctgtgcaccaggaacccgccgaagcctgagagctgtcagcacagattccaccagggagccagcaacgcccctcacttcctcaggcctctctgaaatccagccaaggaacaggcgctgagctcacagtcagatagctcccggagcctccggccctgggcacggtgccctagctggtggagatggaaacagcaaggcccttctgactcaaagactcctcattgcccctgacacctcagacttaaaacccaccatcactgtcattcagcatccaccctgccaggcatgatgcagggagagaggaggggataaaaaagggaagggccgtacagagccagggcagagggaggaaccgagctggagaaagcattaaggacccacttgtgaaaatcctttggagtgctgaggctaaaagcccatctgggtgggatcaaaggggagcccccaacacagcccatgactggaggatcagcaacttgcaggcctagttaggccttgatttccctttttctcagcttttgaggagaactacagtcactgcctgagaaaatgcagcctcaggacacaggattctaattcagtgcctgcacagccttccaaccagaggcctgcaaatggtagagtcgtccatctggatcattctgcaaattgtgaggtcaaattgcattaataaaaaaaagcattccccttttaattctctttctctttcagtttctcatcagattgggatgagatgcagaaatgcatcagattgggaaacacacctaatcctttgctaagctcccttttaaacaacaagcccaatctctggtaggcaagggtgtcttggtaaaacctaaatagaattgcctagtttccattatactcattttgacagtgaatcctttagaataggaagtatttcttgtctaaagtttctgtttagatcctatacatgaagtttttaaaagcaaaaggaaatcacagctcagccctttgcagatactctgaacatcttgaggagaggcagggacaaccggaggtagggaaacggggtctcggatgacaagcctcagctctgggaaagttctggaggtggcaggacagccaggccagagttgtccggtggagacttggctcctgaagccagcggggcacccctgagcagcaggcctttctcagagcaaacatcagtctctctcctctttgtccttaatgaccacagctgggtaggggggagaggctttaactcccaaggaggctgtttgtatccagcctgcgaggagaggcctaaattggcattccacatcataataaaaaaattcccagcaattattaaaagattcttatctcttgctccctacatggataatgagttccttctctgctggactgagacaggctgtctctgctctcacttaatgaaacaggaccaagtttgcaaatgagcttgccccgtctctccccttaacctctgcttgtggagttgtacatcaaaccttctggcttctgtctttccttattaacagcccgtaatcttagcagggcccttgccttggcacttcctctttgcatgtacaggtctggttttcactggacctaatgactgggggtttgcctttgtctttctgggactgaagttttaggggatccaggtgcttctggtttcatcaaataagaaggctaatgaacaatgagagaggggaagaaagagagggaatgtgtgtgtgatttagctgaaaaaaaaaacaccaaaaaaacaaaaaaacactactgctttctctttgggagacattggtgctggaacctgtatttagcaatggttctgtttgaaatcctctacccgcagctctgagttccagggattcatttctttccccaaatccagcctactttgcggggtaggatcaggtcagctgagtcatcttaacaaaagtcactgcattttacttttctaagtcacccctcttggccttccagggactttcctttattttgacaccatttcagcaaaaaccattgaacagggataactcttttccgtggagtatttgactgctttcctcaaagtctcctctactcctagggaaggaaggagactgtgaacatgagttggagcaggcagttttatggaataggttgatccgtcaggccttttgtgtgtgtaggctatctgtctcatagcatgggaactgatggactctgctcccaggacatactggtgctgttatctggtgaagtgcagctgatactttagctctgagatgaattttacttgggatacgaccagccaacgtttcaggagagcttcacttactctttcaggtgctgttctagttgtctgttgctgtgtaataaagtgctccagaacctagccatcttattgaacaaccatctattgtacctcatgattttgtgagttaggaattcaaacagggttcagttgggctgttcttctgctccttatggcactggctggggtctctaggttttattcagctggtgactggctttgtctaaagctccaagatggctttggtcatgtgcctgacaccttggggaggatgggttctctttgaatgctgtacttaactgggttgctttacatctttatattctcagggcctctccagtgatcttccaacagctattagactttgttttcttttgagataggttctcactctgtcactcaggcagtggtttggttgggtgaggggtaggatggaagtagcatgatcatagctcactgcagtcttgaacctctaggtcaaggtgttggacttcttaaatgattgttcaggtatccaagagtgtatatttccagaaataggaagtgacagctgctggtctcttgcagcttgggcctcgaacctagagtacatcacttctgctgcatcctgttggttacagccaccatcaaacctgcccagacttcaggagaaggaacatacattaggagtaagaacttggttggttctcagtctaatgcctacgaaaaaaggtaccagcaacacagaagttccttgaaggatgctaaaacttttctcttgataaccatgactgaagattaatgctttagggataggcagggatgctgaatgaggccagcttgccagtctctatatgacctcaagtttagaaagtgacagtgacagaagcataattttggatacccatacatgttaagggaaactaagatccacaagccgatgaagatgtggtctgggcttcatctttgctgcctgccagagtagctcagggcaaaaaccttaaaatgatgccagcctcttttgccaattgccccccatagatggtcccttgcagcctgggaaacagggaaaccaagagtcacggatgtcatttacaccagaagagtcaagcccttggaagagcagctgccttccttcctttgctataccaggagctcctgggagttacaggaagctccagttaccactgcctccatcagacgggatccttcttcaggaatgcaagctttgacattgcatctccagtggcagtctcttctgtactcccagcacttagcatgtaggccctggaggaatccagaagcagtggctccttccttcctaccaaggcaggaatgttaagtcacctcttcatgactatacctctgccccccattattgttatctctctttccagtcacaagcactcctgagaaataaacttcagatacgatgtgcactgactctccttccatgtttttttccagctcagcacctgaagtgcccattccatttaattattctctgagacactgaagatgggaggaggctatctttagtggatcccaaatctagctttgcataacaaataacctgtgaaacttaagattaaaaaatacaggttcccggaatctccttaaagagatcctgattcaagaggatgtcagggattcgtatgtccccaactcctccctggtcattttgatgtgagccaggcttaggaaccactggcctgtgtattttattaactctgagggatgcagggcccgcatttcaaaggatggggccaattagccctcccagttggtaagaccagcttgattattgaggaggcaaaggcctggggtgtgttttctatagttaggacctgacccatgacctcagccagctgccttgcaaatgccagtggtcaccagggcaacccagccagagagggttaatgattcagagcaaatgcatcttcacaattagtgtgggaggagagggaaaagaaactctctaactaagaacaggccatgctgaatctgtcacctctgaacaccatcatcttttattctgaaaatatgtagtagacactgatgcctcctttgcactttggatgaagtttaacactgtctgccatctcaacaatgttacctactcacatccctttcttccaaagacatctttattaaaacaaagatgaaataacgcacccatgtaaaacagtggttaagacataagttctgaatttaaaggcctggaatgaaatcttggctctgttatttgtgagtggtgtgtgtacaagcaagttaataaacctttctatgcctcaattttctcattctgcaaaattctgataaaattggtaactttttcttaggataaaagataaggtagtacttgtaaagtacttagcacagtgtcttctgtatggtaagcactcaagaacttatcaccgcttttattttattttattttgataaggacatttaacataaggtctgctcttttagtagatttttaagtgtgcaatacagtattgttatctataagcacaatgctatacagtagacctctggaaattattcatcttgcataagtgaaattttattcctgttgataaacaactccatattttcgttcctaaagcccttggtaattctacagtctgattctacgggttagactatcttagagacttcatattaagtggaattatgtagtatttttcatttggtgactggcttatttcacttatcataatggtcttgaggttcattcatgtttttccatttcttctttttaaatatcaaataggccgagcgtggtggctcgtgcctgtaatcccagcactttgggaagctgaggcgggcaaatcacctgaggtcaggagttctagaccagcccggccaacatggtgaaaccccgtctctaccaaaaatgcaaaaattagcccactggtggcgggcacctataatcacagttgctcaggaggctgaggcaggagaatcgcttgaactcaggaggcagaggttgtggtgagccgagatcgtgccactgcactccagcctgggcgacgagagctaaaatttgtctgaaaaaaaatcaaataatattccattgtatgtacctaccacattaaaaaaaatccattcacctatagatggacatttaggttgtttccttatgttggctactgtgaatcatgctggaatgatcttattgagatcatgatttcaacactttgggatacatactcagaagtggaattgttggattatgtaattgttctatttttatttttttgtggaaacttcaactgttccatagccattggacaattttgtattcccatcaacagtgcacaaggattccaatttccctacgtccttaccaatacttattatctttggttttcttgataatagtcatcctaacaggtgtgatgtaatagctcattgtggttttgatttgcattttcctgtgtagttgaacatcttttcatatgcttgttgcccacttgtctgtctttttcggggaaattgtaaacgttctagaagaagacatacggaaaaagcttcatgacattgatcttggcaatgcttttaaggttattataccaaaaccacaggcaacaaaggcaaaacaaacaagtgggatcaccttaatctaaaaagctctgtacaacaaaagaaacaactaatagagtgaaaaggtaacctacagaatgggagaaaatatttgcaacctatatatctgataaggagtaatttaagcaacaacaacaacaacaaacccacctccaattggccaaagtatattgggggcatctgtgatgccttcttcctttcttgtctctcttctctccagctcacacccaccattcaaatactctctgatccagcctattcttcttaccatccacaaaaatgactgtccagactttgccttcaccacctctgacttcatgacaaacattgctcccagcttgtctccctatcaacaatttctcctcctgtgattattctccaacttggtccagtgagacccttttaagatatgagtcacgatgactcattctgcgtaaagaacttactgatttccaatttaccgagtttaaatcttttgcttggtgcacaaagcccttcataacttgccccaaacttgccctctagcccactccaatttacttttctgtgtatggtatataccaatcagaattcagaaccaaaccagaatttaccaatccagtcagaacagctgcatagatgtccccatctgtggtttcctctgtaatttttttctttcggccaagatatcgattaccttcttttctttatggtaagcctcaagtcatccttaaagacccagtcacaatgtcaacagtccttctttgatgtccttaggtggagtcagtctcctctgtgttcccatatctttttctcccccatctctatttaagagtttatctcaaagatatagggtaagtatctgatgtttaggctaatgtcatgatgaagaggtcgggctctaaggtcacatagtcttaacctagctatgcctcaatttcctcctctaaaaaatggagatgattaagtggctgctatccacagttattgtgagaattaaatgaaatcatgcaagaagaatatgtagcagagcataccagtgttaaattaataccagctatttttgtttgcttttctctctgtaggttactctttcatgtgagtttctgaaggcagagcccttgtcttttgcatctgtgcatgctgatctcccaagaccaggcctagcacttactagctgcatgatgatgttggaaaaaagaaaaaaaaagcaaataagtgaattccaatcctgagttaattgttaataaatataccacctgactatcctactacatgaaatgtgggaggagttctaacctcaaatatgaaggccctgccttcctctcccttatttttcatttctactctttatttcttcttccttcctccctcccttccctttctttcctcccatcttcctcttcctcttttctagcctcttttccttccttttcttcttaagatactaagataataatttattaatttacattggagaaatattcctgttgtatgaacaataaacacttttattttagggatcagcgatcatattaccaatttctatctactgggagcccagaaagtaattaaaaattacttgacttactcggtgaggaacagaagtctcctcacaacagccacataattaaacttggaaaaggattctctcccccagccccacttcaaggcatgagaagatggtaggttcaattgacattttaactgagagcttataagagccagaaccacccagcaaagttgctcctagactcctaaaactttgaaactgtatgagataataaatctttgttcctaatgttaaactgctaagtttgtggtaatttgataccgagcagtagaaagcaaatacagtccatatcaacaatgtgttctctctttacagacaaggaggaaaaaatggaacttataaattgatcataacaaataagtatttaacataaaatgcaagtggtaatgaatcaagtgacagcaaatatttaaaaaccaaagtgttattattaatatggctatagtcataaatgttagttgtacaaattcaaatagtatacatactatgaagtataatttaaactgtctgtcttccatgccccagttctatgtggcaaaaccagcaatatgaatttctctaagactatgcctgtatatatataagcaggcatatagtgataccatatcttgcctcagtggttctcaaagtgtggtactagaatcagcagcatcagcactacctgaaacttgttggaaatacaaagttttgggtcttggccatgacttaaatcaaaatttctgaaggagggcacagcaatctgtgttttaacaaaatattcaggtgattctgatgcataataaagtctttggactctacatattactctgcaatctgctcctttcactttgcagaccttgaataacttttcatgtcattgaatagatgtctgacacattctttaaactgccatctggtcctttatcttatgtacataccacacttcattaaacaatctcacattgatctctgtttccaagtttctttagcgtcataaacaaaattaaaataaaaagccttgtattatgatatatgtatatatctaaatgtgcatgcacatacacatatacatatatagctaccacatatacaaaaaactttataaaaaattctctaggagaaattcttagaagttatattgttgggtctaagagtaagtacattttaaatttgggcaaatttgataaattatcttcaaaaatagtacatcagtgtttattagtaggtctaatcttgaaatctgcttccatctcaaggattattaacatttaaatgtcactttgatgggctaaaaccattactccctttatactgcatttctttatttatgagtaacattaagcatttttcatagttttattgacttttttctcctatgaactccctttttcagataagatcctttccaaaatgaagattacaacaaagagcttattctgactagtttgggaagtcattacaaggtttgaggaaaactcacattatgagcatgctgccgattgccttgagtgttttcttgtgatttgtgagtagtgattgatcataatcaaaaaattaatcaccagtcagccctagtgattaagtcacagtcatatttgcatatgtctgaaaatttgtgcaacctatagagacggaaatttagatgaaagttatcgatcatggaagctgtgccaaaggtgtcagtcacgggtatggggatttttactgcagcatggctagatccctaatggttagctcactggatgaaagggaacaggctgggagagggatgtctatgtacagattagtggtttgtttcgcttttctttttttttttttttttttttggagatggagtctcgccctgtcgcccaggctggagtgcagtggtgtgatctcggctcactgcaacctccgcctcctgggttcaagcgattctcctgcctcagcctccttagtagctgggattacaggcatgtgccaccatgcctggctaattttttgtatttatagcagagacgggcttttgccatgttggtcaggctggtctccaactcctgaccttaggtgatccgcccgccttggcctcccaaagtgctgggattacaggcatgagccaccacacccacacacagcctactgttgtttttttttttttgattttttgtttttgtttttttcccctgctagttatacatgtcaccattttaccaatgggttattttgatttcaaagaccatggtgagaaaaatacggacagttcagggcaaatctaactctactgctcaggtagagctcagagtgtaccggcatagaataagtctgaaacaccaacatcatgagctgatttagaataaggtcagcaaacattttctgtaaagggccagatagtattaataaatatttttggctctctggccatacagtctctgctataattgcttaactttgcagtcatacctctaaagcagtcattgacaacacaaaaatgaatgtgcctttatttgcaaaaaagcaggcagtgagccaaatttggcccatgaaccatcgtttactggtccctggtttagataattttagtgttcattactaaatgaccaagagtttgtagatcatacctacagtcaaacatgaatttttcctagtattcttccttcccctacttgttctctttgtttatttttccttctgttttacgttctccctcttcttttcctcttcttttaaataactgggtaatgtgaagggatgatttcttaacatctctgtatctcaatttctaaatctatcaaatgttaataataatagaacaaaataaaagagttagtgtgaagagtaagttaaactaaaaaaaaaaaaaattctagaaaatgctttgagagatatacacatctgcctatatgtgtgcctaagtgtgaaatctcaagatggagaagaaataaaagcaagaaataatatttctgaaatgaaatatttagttttcacacattggagcattctttaatccaagttctcatccattatacaatggcaacatgttttatatattgtacaagctgtaagctgtgaagtgggtgcttttctccttctggcattctcgttctgcctggtagatggagagctctccattcttttcacctggagccagagcatctgctatagacccactgctatttacttggtggagataaactgtgtatcatctgtctacctagaatggatctacgttaatctgaatcaaacttgattttgcaacaatttgagcactttctattgggtagatggacatttcaccagtccacaagttctagctgtatgttgttccaactatagattctgaattctgtgccatctccactagttcttgcttaagtcctaatatgacaacatggcatcctgaaatatgaacaggcaatctgaaggaagttgaaaaatacatgcttataatcacacagctctgatgtcactttaagtagagtcagtattacttttgttgttatgggttgagttttctcctctcaaagtttatacactggagttttaaactctatgcctcagaatgtgcccttatttggaaatagagtcatggcagatataactagttaaggtgaggacatactagagatgaattggcccctaatgcaatatgactgatgtccttattaaaaaaagagaaattttgagaaagacaaatacacagggagaacgccatgtgaaaatgaaggcagagatcagagtgatgcatctgcaagccacaaaacaccaagattcccaacaaaccagaaggaaggaagaagcatgaagaagaatcttcctcacagtcttcaaaaggaaccaaccctattgataccttgatcttggactcccagcttctagaactgtgagacagtcagtttctgttgtttagccaccaattcttttgtactttttaaacagtagccctagaaaactaatgcatttgtaattatactcttaataatagtagtaataataaatcacaaaaaactctgtattgaacaatagttatgcaccagccatgtgctaggtctttttgtgcattattttaatttttgtcctcccaaatgcccctatgagataggtaccactattatccgcattgcatagacaaggaaacccaggtttaaagcttaaagggtttaaatattattttcagggtcacacagatgagaagaggtggagcaaggatttgaaccaggccatcttaatgccaaatcttgtggcctggtttgcttggagaatctcagggagagaaagtccattggagttattccaaggagtattcacttcccatcagcctcagtaaatgagaagtaataagagatatggaaagtgtgatgttgacaatgcagcagttaagtgggagagagaagtgcaaatggacaggtggttatttgtggtgctgctgattcagatctcaggctcacaggtctgagtcatttatttgtttgtcctccaatgttctgtgcttgaaagcaatcaaggtactggccctgtaccagcttccctgagtctgaggtctctccctgtaatcactggcctgttcttctgcacaacagttctggtcatgaattcaatcatgaccactcctttcttcattaggcccctatggaagccgctgaaaatcacacccaaaaccagttttaaggcttgagtccatcatgctgagagccagcaggtcaggccagaactaagttcaggggttaactggaatcagaagttcggaacctattaaattgtccaattaattatgtgtgactcctcccttttcctctccctttttgtcttcacacctgagcaatggacagtaaaaaaaaaaaaagcggggggcttgctgcacacagatgtccacctttaacctgagaagtcagcagcacttatctatcattgcggtcaccctagaaaacataaatccagattctcggtggtctgggaaatggtgctttggagaagagcgagcttgtggcataaactcagggtcctcccctaatcttgaggactgcaagcttaggtgttatctagagaaagtgtctagaggcagataattgatgctttactcacagtctggctacaaaggctcaaggcaggcagacatgagtttccctcctcgccatactcactagtcaagtgcctttgagtaagttttgtatcttctttttcctcgtatacctgactcacaaaatgggatatacagaccttgtggtgattgtgaaaataaaatgaaatgttgcctccaaagcacttagcacagtaattgaagatgcagcactttctgagttaaggccagttccttgtgaatactttgctgttgacaacacaagcctgcttcttccctctccttcctcctctctgttgtgacaaactgcacgacaatggctccaggtcctgactgatcccttatgttaatggtcctgactcctaagacagcttcccagatgctgtcagacctcagcacaaattattggcttgaacttcactctttacagaaagatgggtcccatgtggaatggatctcagcttccagaattcactgaggggtcctttcctgctcgtttactaggtgggcccccattggcctgagggagctaatatgtttcacagcgtgttttgtagattgcatctggccagatgtttctctgtgtgggttcccttaagcaatgtgggagggaaggaacaccctgatgtacatggaatttcagccaagaggcctggtgttgcatcgccttggtctagaccaacctctttttttgttgctcccagggagcaagattgtattccagaatgaaagctcagaggcagtggacccaaggccacttttctccccttccattaggcacatgtcaaagactacttctattgatgacacagccttcagcttctgggatatacttcaagaaaggagcccaaatacaggctgttataaaacattgtcatagtcatgccccaaggtggccacgcaaagggtacttgatagtggccaggaaaaccatatagcttgttttacagggacagtctactccggaatcccatccagtcctatgcagcatccaatgcaacattcccgccttccactcaatttcagtctgagagtatatgaaatcttaattatggctcagagtcaaagcttttccacccaggagttcagcagagatacatgttcttcatcagaggggtagattatggagggcaccagcatccccaatccaggagctgaagggcagctgtagaatgctgtcaccgaggtgtcagttatttaaccaaacagaggagacccacaaaaagtaaagagaaggctgtctggccagacttagaaaaaaaattagggatattgtgtttctctctcttggttgagggatctggatttttaaatctaaattacatttatgggtgctaccatgtgtgaggcttggtggaagatgctggtgaggccaaactccctggtcctgcttccttgtaccagtgtttcatcaaagacagaaggattgggtgtcgtggtttcccagaccacagtagcctagagaatgtgattttagactgggtttaagaataaagggatgagggacagcagcgtagtagtagcacaacaacgacaacactaacagacaacagagaaggcgaaatggctcctgtaagtgaggcactttgtatgtgccattcctgtgctgagatctttataggcatcatcccattttattgttacaaatccaactgagctggtgcgtattataacagaggagaaaataggtgctgagagaaagaagaaatgacttgcccaatgtcacacagtcaggaagtagtaaagccatttcttgaatctaggtgtgcaaagcctgagctcttagctgtcatgtcacctgccttctggagatgtattagtttgcaattttctgtatttctaggacacatcctcccccagactttaagctgggttaagtctctgctttgtgccgttgttatgccgataaaactttccttggttttgcagtagctgtgcttttccctgcagagctaccacattccaggctgtaagtttggctggcattttgctcaaaaagtatgaggcacaggaaagcctctctgcaaaaaaagttaaaataattttattataacccaagtgagaaccaatgcattaccgacattcgtggtggtggtagttaaaatagtaataacagtgattggggcaggtaatactaaaaaagaaaagtagtcagagtaattataataaaacaacaatccctagggtttattaaacacttactatgtaccatttgctattgggacccctttgtatgtaataagtcattcaatcttcaccacaattctcaaggcctgaactaaagtgaagctgcgaatcccctaaggataacttttaaggaggccttcactgtcagttgtaaagagtaagggcttccttaaacgtggcaccctaggggtccctcttgcctcaccctagtcctggccctggcctagaagggttgtgggtgaaatagtcacaatcacaggaactttttgaaaaagtaaactgtaacataaaggtgttgataaattttctgggatcacacagacagcaagtaacagaattataactctaacccaagcctgtattggccaaagcctgtgtcctttgtactaagatatgcattgtttagtttctcaccatcatcttacaggaacttagtcatagcatacattctaggaccttttactggagtgttttctcagagtctctatcttcacagagtatcggagaggagagtatcaagaaatgattttatttatgtgtgcttgcatgtgtgtgtttatctgttagtggttttttttttttttttttttttttgtcacccaggctgtcccagactcaagcaatcctcccacctcaccctcatcaccctcctgagtaggtgggactacaggcacccaccaccatgcctggctaatttttgtattttttgtagagatgaggtttctcgatgttgcccaggctagtctagatctcttgggctcaaacaattcttttgcctcagcctcccaaagagctgggattacaggtgtacaccatcatgccaggccaagaaatatttaaacagggaagagaaagaggaagagaagaaaagaagataaggaaggaaggaaggaaggaaggaaggaaggaaagaaggaaggaaggaaggaaggaaaggttgattcagaagtcagtgtgaggagatacatactgaatctcacctcatattgtctctctctgtgtactaggcagaaaaattttttagttcccatgacataaacccaactcacagtagctcaggcaaaaggtgagatttattttttaaatgtaggattatagaacacattaagagaatagctaaaaccaaactacaggtaaggcacaggtaatgctggtttcaggaataaaatagggaaacaaatatccttttcctttctctctcgctccctctctctctgtctccatcatcatcaccatcaccagcatcgtcaccatcaccatcatcatcaccatcatcatcatttccacaaggcttatagggtttctgcttaaatagaatcttggacaacctcaactgaaatttcacactggaattctcatggtaggtacacagaggaggcctcattatgtgtgtggaggcaatcatattacaagaaagaatatgataagggcatacatttatgtactgcagagtttctaggaatggagaattaacatctggcgacgaatcagagaaaatgccatgaagaatatgatatgatagcatggatgggattttaacaagtaaaagtatgaaaccaagacttagacagggagggcatagcaatgagaaattctcagaacaatacttcataaaacagtcagtcaattacaagctgttgtatttgactagatcatagattataaatcatggtattgtggggcattaggcaaaaaaagtgaaaatattgtagtggaagtcttcgaatagatggaacaatgttattcacttgttcattcattcactcacttattcataattaatatttattgtacacctattagtcacctactaagtctgttggtgcaaagatatttgcggaacatgaataatcccaggttagagccattgatcatgtgaataggagctacaagtaactaagcatagctgattgttcagatattatcaaatagtcctcctaatctgggagttttatacagtattgacatgccgacaaagtggaaagccataacttgcatctggctttcaatgcagagactatgtgtgaaggaatcaaggagctcagaagcttttcaaacaggggaataatatgtgattccatttagtaacttaatactagtggctatagccaggagaaattggacttgggagattatggaagcagaaagaggtgtgtgtgtgtgtgtgtgacagagagagagagagagagagaaagtttttacaagagtttgggtaggaagaagcaataatttgatagatataaagcacacatttgggaatcaaagaggaccatggaagaacatttttagaggacttgatagcctgttgggtatgttgcctattaagggagattgaggactttggtgtctgggtggatgttgatgccgctgaaccaaacagagagacaaaaattaggagccagtgtgagaaacagcaaggaggtaggaggtaggatccgtgatattataaatttaacaggagaagctgtaagttgactagacagcattgaaattggacaaggaggctgagattggagatatcaatttagtcttcagtctacagtggcccttctccatcaggtttcaaaaaaaaaaaaagtaaacacactaatgtcttaaggcatccattgtacgtaatgaattaacttgcttccatgaatggaaaagaagattagctccctaccatctctgtgaagactgaggaaagggtaactcaaatcactttttagggcttaattttctcacatgattttatttgagaaacgttgatgttaagataatagttgctaaaaatggaggttaatgaagacattaataaaaagagtataactcatgtataaagggacctagggtaaaaagattaggtaggtctaatatttaggaagcaagagggaaaataaaggaactggtatggcaaaaaagaaggagtggccaaagaaatcacagaagaggctgggcaccgtggcttacgcatgtaatcccagcactttgggaggacaaggcgggaggatcacgaggtcaagagaccagcctgtccaacatggtgaaaccctgtctctactaaaaatacacaaattagccaggcatggtggcacacgtctgtaatcccagctactcaggaggctgaggcaggaaaattgcttgaacccgggaggcagaggttgcagtgagtggaaatcgcgccactgtactccagcctggggcgacagacagagtgagactctgtctcaaaaaaaaaaaaaaaaaaaaaagaaagaaataagagaagaaatgacccccatgccattgtttatgcagacatgccaaaaatgtcccttcagaacacacaaaattccctctgcgtgtctttattgccatatttactgtattattttgattagttactatcttatctctaactaaaccttgaagcaaagaccacattacatgtattcttgtggccccattttgtagacatagagctgtgccactcagatcctcattcatggaagaacttgtcccaactctcagctcctgcagaatctgcctcagctgcaggaatgtgctttgtccaagggtatgcatctcccatggcagcccatagccagtgggctgatcaaggtgcggtaaaaaggcctggtagcttcatcccaatgtggaaaactctgatgggatgtattccagagcttcccatgggccactccagagcttctcctaggtcgtccaagtcagacctctaccacaagctgactactccatccacctaattttgcttcttgcttctcccttccaaaagtgtctatccctaataaaacattgtatgttaaaccctgtcttagcgtctgctgtgaaagacctagccattaagtctagatactgagaaagtcctcagtagctagaacaagatctaacatacaaaaagagattagtacctttggtgtagagaaacaagttgtgacctcaaagttgcatattttattcatctgttcaatacaagttaagcatctactgtgtgacagactgtgttctaggcaccagatttttacatagatggaattggtctttggtgtctttaagaacagtcaatcagggcaggggcactaataaaggattataaaatgctaaggaggatgggagttgaggtgggtcagtgctgtgttaaatataacccattatactgaggttagtaacttttttttcaagagttatagaagggcaagaacagaaagagatgaggtattgctcaaaatggcatggatgagactgatattgctcatggtgtctgagatttcctttccccattggcactctacttgactatgcaccttagccttcttgcatctaggtgtggcaatgtgattatttttggccaatgtattgatgtgaacagaagaaatatgcatgacttactctcctgggccataaaactgcccactgaagattccccattttatctttccccatactgcaacagaatggagaggaatacaagggcccagagaagagcagaacctccagaggaaatgagcaaggatccctgaatgactttatggagcagagaccctctgcatagacccacactgtactctgatgtaagcaagaaccaaactgttgtttataaaactactaagattttggagttgtttgggaaattaggtagcacactccaactaatatatgtggtataaaatttaaaagaaaatttttttccttagagtaggctagtcttgactacatttagaggctaagggtatggtgccatgaaatataaattgaagaagcaaatgagagaatggataatcgttagagcaagttccctgcggcacagaaggaagtgacccagaacaggatcttctgttctcctgtgctttgttgtcaagaaagagaagaatattggtcatttttgttttagtgcttttactactaattattaactagagagaaatgatgaaaaaagaacaaggataacaaatatatcaaaataacaaaggttcaagaaccttttcatgttattacacacatggtgtgtttcaggaaaaaaaaatcatagcaaggaaaatgtgagtttaaatcctggctttgcaatatttttgttgtaaaatatgaagacagtgcattctgagattattcacttggttcagttgagacacaggtaaactgatgtacatctcatatggattacttttttgtgtgtgaaaacaaaattagatctcatgtcattagcacaggaaatggaatattttgaaaattataacaatagctaatctttattgaacagttattctgtgtcaagtactgttctaagcaaatataagcattaagtaatctatttctcataacaactcaatgaagtattgttcttttactacacccattttatagataaggaaattcactcacaaaatattaattgccagtgcttttctttgggtagagagattatgggtatatatttcttaatattttcatattttataagattgcctatgtggcttttatatttacaatataaatgctattttaaaaacaatgacaatattaggcttaattttcttttaaagaaaccagaagtatggctcttgaatgtgacatttaccaaaccccgactctgctaaggcatttgcaaaggccctgaggccatcctccaatataccttaatggcacatagacttggtggtataatcaaccaaattagatcagtgcctgctctttgccctctgaatctccagctttggtggcacccagatcagtatgacaaacccttctaggcttctttctatggaaagtcttatgggtggtttttcgctggataactgagtgctcttggaacatgctgttgaacctccctcacgtcaccctcctgtaaaaaggatgtgttggttgagtatcccccaaagtctgactttgagataggaatttcagcataagtagtttatctgggttgcgaccccagcaggcacagtgagggggtggagaaatgagtcagggaaaggaagagaggcaataaaagtggtattaactagtgtgttatcgctacaggaagatgggcctcaattccattggggactcctaagagcctgtgcagaacataccttggaactggcctgctatggggcaaagaagttggaatgtcattcatcaacatcaccaacttttatccttaattattataaggttacccttggtggtgtcaacaccttcaggtttctgggtgtccagcgcagtgggccacagttctcctgtggccagaggacattctgtggcagagagacacaatttcctttgacgtatatggggattcttgttaggtgacctctggggtaagctgatgggggacagggccagacaccaacagtatctgctacagatgttaaaaaaataaataagatgacacatttaaggatttagcatataaatgcttaataaatgctagctgccataattaaaatgatagcattagcactatcataactagtgcagaactcatattaaaatccaagttttgtgaattctggtctcagagtattttaattaatgggggaatcttcatgtttctttttcatggttgtatttccctcgtttaatctttatgtttgtgtaaactaaccctcagttctccattcttagggtaggaataattaaatgggaaccatttttgcagactaaattttccatctctgaaattctgtgcttcaccttaggaaaacccccaaactaacattagctactattgttgttttatttctttaagccatgccacttatggctctggggtcaggagatagacatcttgtttttatgaaggctcccaaggggtgaactgcagtcaaaccacgtttccctggaagacttcaagccattttagctgctcaatggagaacacatcccaggatgcaggcaggtttccaagacaactgggggtttgattgttcatagaaggatggccaaagcagctgcatattggtgctttggaagtctcaaactattccacaagagctttgagttctgtaaatccaaaacatatttgctacaaatatttttcttttcattttttaatcacatatatattacaagggaaatatattccatctgattttttttactcacttatattgtccaaatgaaattttgaaatgtatttgatgttctataatttaaagaaaaattcactataatggaaaaacatatttggtaaaaggcaagtgcttctgctcttcatgctgctagtgactgtgggtcactgaagtggcctcagagtcaacacaatgaattggccatgtcgtggattcctttgaaggatggttccagctctctcagtggcagatacaatgggtaacaaagggctcatctaattctattaatcacagaaacttggcaaagagaagagtatggcataaagaggttcaaggacctgaaataccagtgagtccaacctcactttattttacagctgaggaaactgagccccagaggggagaaattctttgcctaatgacacatggttaattaaaggcagatttggggtcataaacttaggtctcctgagactaggagcagggtaccagtattctttctactgtctgtgctgtaaagcatcaaagcacaaatacaaaatctgactgcaaaactgaaatcacaagtgtgttcaagaatcatgggctgttatgaattttggaggaacagggaatacagaagttttaaaaacagactctccttcaaagagcacaggctctggggtaggctgtgatgtgctcctgttgcaattttactacctccctaatgataatgactttgggaagttacttaactgctctgagtttctgtttcctaatctgaaaaatgggttaaaattagcatccacacatcagattgtcatgaaagttagataaaaacctggatataaaaacacttgctacagtggctaccatggagcaaatattaaaaataaaacaaataaaaacctttttaaaaaaagtattactattaacattattattcaatgatcttactttccaggacagtgcttcctaaaactgtgttttgtagaacactaataccagacgatggatgtgaattgatgtttgggtttgtgtttgtttgtttgtttttgttgttgttttgagacaagatctcactatgtcacccaacctggagtgtagtggcatgattatagctcactgcagcctcaaactcttggggctcaagcaatccttcctcctcagcctcctgagactacaggcaaacaccaccacatcctgtccagctaatttatttattttttgtatgtggagacaggttttcactgtgttgcccaggctggtcgtgcactcctggcctcaagcgatccacataggcctcccaagtgggattacaggagtgagccaccatgtccagtctgtgaactgatataacaaacaaataagtgcaaagaaaatatcctatatttcagtgtgttttgaaaatacatactccactgttttcttggctattcttaatgcataatatgcaactggtagtctgtaagaaagcattcaggagagaacactattaaattgtgttgaatgtaatgtaaccaaaaatcatgtatttttctttttaataacatgcataaattaatactgtatgcaatagcattctgttatatatcagttatgagaatgtcagtgtaggagagataataggtagacacaaagctataatgcacatggatcatgatccatcatcaaaagatgtgtaaaggtgactgccaagaagcattcctcttccaaatgtgtctgcttcatggattcttcatgaaggaaaaattattacagcagaagagggttaggggttactcagagattgaagtgaggaagttcctggacacaaaagtaagaaagtgctgaggaagttttggagaacagcaaaaatccaactttacaccttcagcagtgggcaggatttgggggaagcactggctagagattgtgggaccagcttatcttccttttcttttccaagggccggaagtatgcagggtttatttttacatttacaacacctagtgcagggtctggcactaagtaggactcaataaatgtgcactgagttgagaccagatctaagtggatgtgaaaagccatgacaaggaatctggatgctatttggcaggcaatggagagcccttgaagcttgctgctcaggggagtgacatattcagaaaagtacttagagagatcggtttggcaccaggtagaagatggaaccaaggagaaagaaactggaggcaagaataaatccagaatccatgcactattttaaacaagaagcaactgaactcatggatggacagaggagtggagatgcagacaaaagagcagctgcagaggtagaaaactaacagaaccttcagtaataatatttcttaagttaaaagaggaaaattaacagggtttcatcaatgatttcttattgtgcaaagaaaaagagatgaatcttgagactctgagctctggttctcttaaaagtgagagaatggtagtgtcaaggacagtcaaaacgagtggggaaagtagactgttcgaactgtgtagaaagatgagcccagatttgaactttgagtcaagcttgaggagctgacaggaaatagggcagataatcagaaagaacttggaaatgtgcaacagaaacatggaggataaattaaaaatgaaaatgtatatctgggatccacctgcatggagctgagatccgatgttccgtgagtagataggagggtgatttagagacttgagggaaaggaaagtgaaagtcaggagcatcatttcccaccattgtccacagctgcagcctgacacagcttgttccatgcccaccccctggaggcagatggctacgtgcaatcacaccgctgtccagtgcctgagtcaaccctttagctctggtctagctccccctaggggtggagtttgagcatggtcttgctgttttgtctaggggcagccctaaacactcacctgcccactcaattgaattttttccctgcccctgtagttgtcttcagaatgcagtctcctaaataagactacttggatttgaacttcagcactagaagaatggaagagttttttttttttttaacttctctcttccttttcataaataaaaataatatgtatgtgatagtgtttgcttatgaagagtaaatgtaaagcatttggaaaattcttgacatatagtagaagcttaatatatttttcccattattatctgttttatcacaccagttatttgtgcttagtactgatgcctgggcttatgactcagttttcgtgaaattattagaaacctgccctgaagctctgttcccgttgcaaaacaaacaaaactcagtttaacttgggtcacctccagagtcaggctcttgtccaccctaacccctgtttcgagactgtactgactcttgtcatcataggagaacagaaacttccgcacccctcccatcactcactcatttattaatttattgaatcacccattcaactaagatttattaagcattcactttgtgatgggcactctgtctacaactaccaggtaacactatctggaaactgaggtagccatgcctttgctattctggacactgtaatactgtaaccctccactgcagccaccatgacagcaggaaggattgacactctatcctcacatgaatttccagtgtgctttgaggttgagccaccaaactcctccagcaaactgccttcttttatttatttatttatttatttatttatttatttatttattattattatactttaagttttagggtacatgtgcacaatgtgcaggttagttacatatgtatacatgtgccatgctggtgcgctgcacccactaactcgtcatctagcattaggtatatctccaatgctatccctctcccctccccccaccccacaacagtccccagagtgtgatgttccccttcctgtgtccatgtgttctcattgttcaaaatgatgagttcatgtcctttgtagggacatggatgaaattggaaatcatcattctcagtaaactatcgcaagaacaaaaaaaaccaaacaccgcatattctcactcataggtgggaattgaacaaactgccttcttatatctccccagactcatgagcaaatggtagcacagggtaaaagcccaggaagttcatgctgatgccttgggaggatacacaagagggtcagtactgcttttaccccatgatgatgcaggcaagaagacatccatcctcccatatctgtttacatcagccctgatgcctcataaaacttccccccatacagtcattaacgaggtggtaacaaggatatcaggggcccaggggagacactctgtttgatgttctggatgaaggaaatgcagacttgctctttgtgaaagtatgagggctaacttggaggcctgcctgacagtccctgtaagctcagacatgaagtcaggggaatacaattgtgtgaaagaagcagaacagtgaagtgttgagatggcaaaatttggaagcccaagggcagggagcagaacaggaaaaacaggcataagagttttccatgtgggtaacataaaatgattagtgacatccacatcaacagaaggctccctgttctttgcttgtggtgtgtttttgtgtagacatccacacttccgatccacagtgaagcctacaaaggggctgagcactcttcctgcagtgaacttatacatgtgcaattgtacgtgtctttatttttctctttgttatttgtgctgcatttaaccctatggctggaacattataaatgttgaaaactttgttgaatgaataaagaaataaatggctcaaagatgggaccatttagcaggaagaaggacctgccaaccttctttttctcttttttgtctatggaaccagacaagggcaaaggatagggaagtggcactggggaattccactctagaatgtccttgagactcccagtcattggtagggctgatgcttaccggaccttctggtgccaaagatcaatgtcaccataaccagggtaatgtggggaaggcagacctcagtcctcagcccagaaatggcaagttcttctcaccccacatcctctcacactcagggctggcagcttttgaatggggaaggaccctttgttctacccaaagatgatcatctaaatcagaccaacagtccagctgggacatccacatataccttagtattctctagtatttattagaaattgggcaactctttaccttctaggaacaatctgcagttgtgtggaaggatcattgacattgtaatatcgacagcaaatagcttttgagcacttatttgcgtgggatacttttaaaatcttctacagccattatctcatgtgtcatcacaacatccaagaggcaggaacctttactcctcttgtttagtacataaggaaaatgaggtctggagaggtaaattaacttttttatggttacaatgcaagctattggcaaatctgaactgaatccaggaattcagccttctaagcaacgctcttaagcattgcactgaataattagactcatgtttatatctaactttacatctagcactagatgactttgtggttttaggtctattacatgcactagcctccactgttcttatctataaatggaaaacatagtgtgtcccacgattcttgtaaggatatgtgctagacacctcatcagagcagtgtccagcatataggaggttactttcattcccatcactttggtcattaggagaaactcatgaggaatgttttggtctccagttctgccgagtctgtctcttcctggatctgcgagtatatatgatggtactcttttcccctggcaagagaagggcagctgggaaactgttgcctctcaggataaaggagaattatcttcgaggagtgccaagtgcgtgcttattcataaaacaaacatttatggagcttcaacaagagtctgggcagcagcaactatagcgtcagggactgtgcagttggttcattagaagctgaagcccccctggaggcctgcagggagcgggcctggaagggggagtggagtgcaaaggccagctggttctctggcaacaaagtcaacatcgccccagatgtctgccctgaggttgaggccattagctccagtttacctgttcacttcatttttcaaaattagccacaaaagcctcccacggaaacacaatgggcagcatttctcagcgggggcaaaaagaaaacaaagcatatctttccatgcacttgtttggagtttctgaatgtcccccagagccctggaggcttggcaggcacgatttggattgctcccacatggatgtctgtggaagccccacttttctttcctctcccagattcaccccagctaaggccaggctgtcccacccctgtcatcagccttgcctgagcaccccaaccctaaacccaggaagacaatgactttctcattttcttgctcctttttcctaggggataatattacagtttaaattcctgggttgactttgagagttgctgggagatggtattagctttcaaccacctgatttaatctcttctctcactcccaccttcccccactgctgttcagacaaggcagagggcaaaggggagaggtgaggaggttaaacgcttgactgcagagacatcttttcatcaggttttgttgagagcagggcagacaggagtagccagggtgtccgtagggcaatgacagcttgtgtctgtctcttgctgactgtacagccccatatgaacttatatgggagaaatggggagagagggccaagagaatgtaatgatgaaaagaaagatgaacaaaaatataaatactgaagtataaggctgtgcagttggagctgtccagtgcaaaatacatttttgccctaagacagttctctctaacctaaaaatcaatagaaagttatgcaataacctactgtgtgctaaaaaaaaaaaaaaaacttgccccaaataaaaataaattgaaaatattggtaggagaaaaaacagcttctttaaacacaggccaaatgcaaaacaagtgaagagagaaccctcagatgtgatttattggtttctatttttaatctttggggagtcaagggaataggagagatgccaggagtttggaaactggatacaaggaatgtttttatttacacatgatttagctactaattaaatgtgtcgtttactgtctatcctgcctggaatgtaagtaccaaaaggacagggacttctgcttgcatcttttccattgaaatatcccagtgcagagaagtgtgttcgatttgtagtaggtttggaacactatgtgttaattgagtaaatgacaggaaatagaggtgagtctgcagcttccctcagcaaggtgtttttcaggactactgtttgcaggccaggtaattgtgggggtctcttcttggtttgagtctctatttggagctcccaaacttctctcctcactatgtgtgtgtaatgtatgttttcttgtctttactaaagaagttagtgaaagattttagtatcctctgactcaccatcctcctgacttcaagagctctttctttctgcgtcgtccttggctctggtcttaaactcaagctactttgggtagtgtagtaggctgaacaacaggccccaacaggcatcagttcctaatccttacaaccttaagtgttcccttattagggaaaaggatctttgcatatgtgactaaggatcttgacctgggaagaatatcctgttttatccaggtggttcttaaattcaatcataaatgtctttataagagagagaaaaaggacatttgataaactcagcgatgaagacaatgtgaagatggaggcagaaatttaagcgatgcagccaccagaagctggaaggggcagggaaggaattcttcactgagcctccagggacagtgtgttcctgctaacaccttaattttgtcccagtgaaactgatcttgaactctggcctccagaactatgagggaatacatttctgttgttttaagacacccagtttggggtaatttgtttcagcagtcataggaatctaattcaggaatgctaccctactcttttcccttggagcagagctaagggcttagtcagaggtaaggctggtcagaactgaagagagactggaattaaggacaagaagttggaactgggggctggtgcagtaaagtaaagccagttgctctaagacacgaatggtgaaatcttaatgctgtaacacaatatacatttacatattgctcttataaagcccggttggcagcaatggtgagggtggagattctgtttcatgagaaggactcaactgatggaggctcagccatccttactgcatgattttattgtaacttttgagttcagtggtacatgagcaggtttattatataggtaaacttgtgtcatgggggcatgttgtacaaatgatttcatcaccaaggatcaccgaggtattaagcctagtaccttttatttatttttcctgattctctcccttctcccaccctccatcctccaatacagcccagtgtgtgttgttcccctctatgtgtccatgtgttctcaacatttagctcccacttataagtgagaacactttaattgatgacttttgaggttgtcttgggcatctgcatcaaggactcagatgaagatgggggaaagaggggggccaaagggtatttataatccaagcctgcaaatggcatacattacttctacccatattctatgaagtataacttagtcatattaccccacctagatgcaagaggtctgggaaatctagttcctgctagggtggctatattccaaccacaattttatattatggagaagaagcatgagttcttaatggacaacaagccaagttctcaacaaaaagagagaaatgctacaaaggcaaagggactaaaataaaaacagggtagtttaactcaatatgagtttcatttcaaaagtcacacaaaatattatgaagtagaatataaaattcacatgagtttttaagatatgaataaaaaacataaagcaaatctgcctttattattcatttttgagaagacttctcatccagtaggcttatgtatctactcccctatgccttgcactgctgagaatgtaaacacagagtctgcaaccagcaagaccagggtgcacattctatttcctttacttacttacgtgtgtgaccttgagaaattatttcactgttcttaagcttttatttctttatatttgggaacaggggagtttctggaggtcacactatcttcaggatacaaagacgagatatagagaagaaaactgcctaaagcatgcgcctgtagtcccagctactcgggatgctgaggcaggagaatcacttgaaccctgaacccaggagacagaagttgcagtgagctgagatcatgccactgcactccagcctgggagacagagggagactccgtctcaaaaaaccaaacaaacaaacaacaacaacaaaaaaagaaaaaaacaaaaaacaaaaacaaacaaaaaactgcttaaagtatttatttctgcaccttcaagagtgggatgagtcaagatcatacttgaaatctgagcaaacatagttgagtggccaacagaaactacaatgcacatacctcacttcctgattaatgggcctccctcctggcaaggatgctaggaagagacactggtagcctggtgagtgccacctaggggatgcatggggagcagtttgtgggtgcaaagaaaatgatgaggtcgatgatttgcatttataaagaattaacttggctgggagcggtggctcgtgcctgtaatcccagcactttgggaggccaagacagaagtatcgcttgagccaaggagtttgagatcagcctgggcaacataggaagactccagctctacaaaaaataaaataaaataaattagtgtgtgtggtggtgtgtgcctgtggtctcagctactcaggagtctgaggtaggaggatatcttgagcccaggaagtcaaggctggagtgagctatgatcccacaactgtactctagcctgggtgacagagtgagacctccctcaaaaaaaaaaaaaaaaaaaaaattaacttgagactatctgctccaaagagcttctagatactgttttgtttatttgttgtttgtgccacgatctcgagagcatgtagataattaatcctgaagttgcacatccgcattctatcttctgttcaattcattcatgtaattaaccagaaggaattgtgatataagaaaagaattttacaaaaatgctgctcttcatgggacagttaacctagaaacggaactgtctattgcctgcaaatatttggcttttcctcttcttattaccacccaaaaggggtggctttacttatagggctacctagaggggaagaagaaccaagtcaggctaaaaatccatgacagagagtcaatgagtcaatgagtcaacacacacacacacacacacacacacacagacacacacaatatttaataactctaataattgatgataatatgaaagtctggaagtgtctatacaataaatatgttaaatctgactaaaattaaatgagatagcagaaaatgtaataaaaatatgatataaagaaagaaaagaaccaaatactacttctagaaaagaatagagaaaataaagactttttttttaaagccttcatgaacaaattaaacaccagaatagacacagctgaagagagaacctatgaactggaaaacagatctgaatgcagcactacaaaataaaaaggtgattgatatgtatcgtcaggtctaaattgcaagagatggccaacactggtgaaaaagtagtctactaagaagcctgacaactgcactgagtaaaatatgaggcatggtttgggacaagatgttcagaactaatactaggaacatgagtgggagctggagttttgtttatacattgttgcatagtggtggcattccctaaccccaattctgtgtgaccatgatctttttggtactgtgtacatgcagtctctcacagaattacttcaactggtggtgttactgagagacactgaaacagcaatagtttattcactgaatttttctttaaacacagatctgtatattagttttttaaaagaatattaataataaaattatattttatatgccttcttaaatggtgttcactaatgtcaggcttaggagaaaatatttaagattcagtaggaacctagtaaaactagggctataattataatggaaactgcataaatcgctccctctcttactcctacagccagcaagacctcttagggagttccaggtggatgggaaaaggggaccaaatgagttcatcaccagaagcaggcctcagaagagaaggtaagactcactcatctcctggtgggcatattcttgcacataaaaaggtcagtatgtgaaaggaaagttcttggctactaacgctgcaaccagacacttcctgctgaaaaatctcagaaacccctcactctcacctcacactatcagggctgctattttcagctgtccctctgccctatttgccttcatgcctcagaaggcacagaaatcatagccaaagtttgagctgacaaatgttcataaaaccaaagaattcccaagcaggattttgagcttgaccttagagcagttggtcaagttggagatatatttttaatgtaaatatttctggtaacatgagcttgggatttatgccagcaaagcttctgaggggccttttctcaccctgtgctctgtgcataagtttctccttcttagacacttttcctctgtttaggaacaaactttgttttatgatccctaaagcagttagcaaactgatgacttttctaaagctgaggatgaaagaccatataacaggttgcagagattaagttgaggtccttaagaaacagcttctggtctagatttgacacatttgcagacacttggttctaaactattgttaagcattagaaaagccttgctcgcttatgcacaatacattctaaaatggacttgaggtagctaaaacatataacattaagaaagagcgttagaaatatacaaacaatcagaacctttggagaattaattatgctaaatttaagactaatggagttattacatttgggtaatgcttttgagcttcctggtggccagagttaaaagaaaagtctaacaaaaagaggaaatagaatgatttttagggagaaataatatattatttttcattttatgtatcttgccacagatacagttgaaaagaaatatattacataaaaccttctaatgggggcactaataggtacaatggaaaacgccctctgcagcaacgttaaaactaagacaaaattggtttttaaatgtttgtttgataaatcaactttgatgtttaataaagaactagggtacatagaaattattcaaaaattagttgttgaatgaatgattaaaaagatttaaaagtgttcattttatttaatgacccgataacttctgatggaattaaccagacactatttcctggagtgatggtaatgaaaaccaaattggagtaaagttcttggaaatggatgtagtgatgcagacacctttttgagaatgctgctgttaaaaaaacacagaaaaatagaggaaagtaaaatcaaagatttttttttttaagaaaagagagatttgagcagatgatattctgggaggatccactgtagaaagagtgcaaagttagggatgaaacaaagttgaatggcatctagagcacaggtgggtggaggaactggcctcagacagaaatatggaacctcttagagttgcttttgatctgggtttggtagcattacctgcattgtatttccaccaatgtgaacaattttatgattttttaaatgagttatactgaactttgctttcagatgccgttagggaaactgtgggaaaagcagctaatattctctctccaccctccttcaaatggggccattttctattcccttttaatagttgaatgatttataataagggaaactgtgggaaaagcagctaatattctctctccaccctccttcaaatggggccattttctatcccttttaatagttgaatgatttataataagcatatattactttttaagtaaaaataagtcataataacattgccaaaaaaatttcttcaaatgatatgttcccctttgaacataggtttgtgtattctctcatttgtttgagaaaggccaatgacctcagataatccttgaagttagcactgattttctgcttaaagatggcattgttttgaattgtctaacaatgggtaatctaaatattatttattttatgtttttggatataagttttaggagaattaaaatacatgaaaactatgattgaatataggaagacaagttgtatagtatttataggagaaaattccagcaatagtctcaattgtttgagacttctcactttgtgataaaaattgctcctgtcatcactgtcactgatcttatagacaataattttattttcatttttagagacagggtcttgctctattacccaggcttgagtgcagtggcataagcatagctcactgcaacctcgaactcctgggctccagcagtcctcttgcctcagcctcccaagtagctagaactatagacacatgccactatgcctggataattttttttgtagagacagggtctcgctatgttgttcaggctggtcttgaaatcctgggttcaagcaatcctctcacctcagcctcccaaattgctgggaatacatgcataaaccacagtgcccagccagggtctttagattaggagatttatattatttcaaacagcaaaaatacgcttgactacagacaaaactgaattttaattaaatccaaaatggatcattgaaaatttgtttattttttctgtacacacacacatacatacatgtcaacacaggggcataatttatcttccaattgtgctactttttacaaaaatagtaagaaccaaatgtttaagagtgatttatattttcagtactgatctgtatgttttgttccatgaaaactatgaaaaattttgcagtttcaaatctcaaacttttctgagtaatgggtatagtgaaattcttccatggtcatgttaaatgtttgggcaaaagcagaacatgcttgaagggatcatgctgtataaatgttcttctttctttagatgctgcagtaagcctatctctgcttctcagctagttttagaagtggcattcttaccatcctcagaacaatactcagataggtaagtggaggaagctgcctacagcaagcaagagttttagttgaccttacagaagaagagtactgctggtctcccatcccttccctgtttgtctaagactctgaaattaaaggctgatagagtgtgtttcttgttggatgcacggcgaagttcatcatgtttagcctacctgccactgggcaacctaaaaccaggtatcagaagaaaataaataataatcctggcggagaaaagtgaagagaggaaactagtgagaaagttgtgtgcacaggtgtgcctatgtacttgtgcatgtgaataccagtgggttgtttgttgcagacaaatgtcagtttaataggcacatggcagaaattcctaccacatgagttctctttcagtttgctatggaagacacaaaaacccgtgagcccatcttactggaatgcaaacgccctgagagcctggcacgtaatagctgctcagcagggggcagtgtgacacagtcattaagaacttgaagatgctgctccctctgggcctcctcttcctcatctgtaacatgggagaatcagtcttttcatacagagtcctgtaccgtttaaattagataatagattcctaaccatgggacagagtaaatattcaacaaatagtaacttttgtcatttctactttttaaattcccgttacaaaatatctccctccaagttagaatgctcattcaaatttcataactgtgtatctttgtctgggaggtcagggaacgcctccaactcaaaatatctaaaaactaactcatggccaccctgacctccctgcctggtgtttgttcagagatccctgtttcagagaacaacatccagttgttttataaacggtttgtcatccttaacacctccctctcccctactcctgccatgctaatgtgagttcttttgatttaatcacttaactccctcttggaactccccatttcttcccattgccccatcacctccacagtgtaagcagcccgtctctaccattgaagactgcagtgcagtcctaactggcctgttcctcacatcctctcttgccctcctccaatctgtttccacatggcagaaagaccactcgtgcaggaacagaaatctggccctgctgcctctgcttcaaaacctgcatcacttccccggattcttaaaatgaagaccaacatacttccacaatcactccagcttcagctggagtcaagcccctcctccccctcctttcttctctggactccactcacaccagatttgtttcagttcctcaaaagagcatggattcccctggtcacaggacctcagtgccagctgggcttccattccctgtcacacccttgaatctggctaaccctatgtacccctcagttttgttgcttcttcagaaaaacctttctgagtagaaccatctcccttttaatatgtcctcacagtacttgtacctctctctctcttttttttctttttcttttccttattaaattttattttaagttgtggggtacatgtgaagggtgtgcaggtttgttacataagtaagtgtgtgacatggtgatttgctgcacctatcaacctaccacctagttattaagcccagcatgcatgagtgtacctctcttttagaagtgtttatcactgttaatatgtaacatatattttggtagttatttgattcatatatgtttccccatcaaggtataagcttcatagggccagaggtgagaggtggggacagaactcatagttgttcacctttggatcaacattttccagtgtaataatagatgctcaatgtgtgtgtatttgtgtgtgtgtgtgtgtgtgtgtgtgtatgtgtaaggataacagctctcttttgtaccccaggactcacccaaggttttcttactttttgtttgttttgttctgttttttcgagatgggatatcactctgtcaccctgcctggagtgcagtggtgtgatctcggctcactgcaacctctacctcccaggctcaagctatccttcacctcaacctccttagtagctgcgactataggtgtgcgccacctctcctggctgatacgtttgtattttggggaaagatgggttttgccatgttgccaaggctggtctcaaactcctgagttccagtgatctgcctgccttggcctccccaagtgctgggattacaagcatgagccacagcacctggccttcatcaaaggctttaattcactgactccctccatctgtagtttagctatgtaaaaccctgtgaaatcaaggatttcaatatgtatgtaatgacaatgtaaagccaaatgataattggaagaaactattctctgactttgttttggggtccttttgttcagcaaaggcctttagcacatgctgtctagggcccaacttctctctatttcaaactgaattcagactccataccacctaaaaatcatagactcctggagtggaaaatcagaggtaggaaataattagtgagagaaactgtattagtcaataactttctctctctctgtgactgaagtaggaaacagacctgaggcttcctttaaaccaagtatcaggtgctgagttccagcaaggaccagaaaccaggtagaaaccccaagtcagaaaataactcaaagaaggcatttatatactttctgagacagtggtatagggtgcacaagagagggagaaaagctgataatttagagggctttgattcaaagggttgcttaagagtattatgtaagcgtcaacccagctgcctaggtggcaggctgaaggtcgtttctggaaagttttacaaactttgggaatgaattcctcttgatactgataaggaacaacactccctaaagtgaatgtgcaaaaagatcacctgggatattgctaatattcactttctgatttggtgggcctgaggtaagtctagtgatgctgtcattctaataagttaacaggtgatgtcaatgctgctggtttgagtggcaggtatgtagtacccttctgctcatcacttgtagtacccaagtactcatccaggacaatgattccagggctgatataaaccatggcccaggttggcaagtttgctttcatccctcctaagtgctctgccactggggtcccatgtctgctcccatggtctgtaaatgcaaatcattttcaattatcagaaaagcaaagtggatcaccatcagcctgaaatatactcaggttaggtaaagatctcttgatagattcttgtgtccaggactgtgggttacacctataattgaggcagtgcttagcaccctttgatacctactgacaggctgaggcaaaagtgattgaaagagatggggtgaggatggaagctgcatagtaaagtcaggtactcagtattaatacctaatgagtactctgttatccacgtgtgctatttcatttaagtatcatagcagtttaatgagaaaggaactttccatttcactcccattttatggttatggaaaccaaggcctgaagagattaagaaccctgccctaatttgtgccgctggcagttgagggagcccagattctgatccataaaggctcatttgaagtctgttgttcttacctggctgcacattagaattccctgaggagctttcggaaaatatccatttctgaaccctcaagaattcctatttcactgctattttaaaaaaaccagtccaatgaatttaacatatatctgagttgagtacaatttcctaggctctgactcttaattaccagaatttataccctccagagactaagttagacattaaaacaaagaaaaaaaataggaatgcttggtggggtattttgcggaggctgaattttagagctacccaatgcaataagactaagccatcgcccactgaccactaatcttacaatagcaggacaatgtccagattctatttgctgggattctacgtgataatagctatgtataccatatgtcaggtgacacggttctaaacactttacatacactgcctcctataatctttcaaaaatacaccgaaatagatatcactaacattccccattgtacagatgagaagactgagattctgaaaggttaaatgccttgccttattacaggtggtgttaggattcaaactcaagtactttggctctagtccatgggataaacaactttgcccactgtctgtcactttatgggccacgcttgtttctcaccagctccgatgatgtagatcttcaccaccatatgtgaagtgagaacaaaaaagggctgaaagagattaattttactgaaaaatgcagtcgatattagagaatgaggctcagtgcgtaaatgtttaggaaacactaatttccatttaaaatcaggagccagtttttatctggcaaagcccttcagcaaagaaaaagttactctgggcaggaatgagtcccttcatcgctgatacgtcagatatttcctggatacctacatggcagggatgttgttgcagggggttggagatggaatggggtgggtggcctgcatgctgtctgaggtctcccttaggcatgagttgctgtgatcctgtgatctgacttaagtcctccaacactcaatcagtaagcgagggcttgatcatttacagttacacagtgagatgtttccaggaatgatttccctgtagcattttaataagtactctataaataataatttattgaagttgcctactatataagaaaaagaatatattaaagaagccgagctaattgaagctggcagttaagttccctgaatcgaaaccaatcggtttatctacatgactctaaagatttgggatgaaaattgctcattatagtctaacatcctgatacccaaagatccagttgtttcacaatatattgacatggccttccaggaaacctatgtgcaatattgagcttaaaatgttccgatacaattaaaaataaattggatcagaaagagcctttactcttctttagttgggagatgaagggatttgaaagatactgaaagctgtgcgaccccagtcagcaagattgctggttctaacttggatgaccacacagcttaagttgccagtgactgtccagtttatacctttggtcccaggataatgtttaacagggcatccattccctccccaagtatcttggtttgaacaatcattgcataatcactatgatcatcctggttaacccacagtgagagagattggagagggcacaatctaatgaggtaaaaacaggccctgaggaagaccaagcttcaggtggtaagagagaatacaaaccaagaggcagaattggggtccaaggaggagcattgtctcatgattcctcaaacatcttttattttgtgtgagtctataatttcatatagtttgttcctccctcagctcaacttttgcacgtatgtatgtgcatgtgaaaaatcaaaaacccatgatcattcttttcctctttaatgtttttttctcctgattgcattattatagggttgttgaggacaaagacagtagagtcagacatgtgaggtgcaaaaatcctctgaggattttgcattatctggcttgacagttcagagactgtctctgaactgtcaagccaggataacaactaacatttttgagccctaagtcaatcacaagtattatttttaatattcatgtaacccctatggggtacgtattaccatgatccccctttcacacttgaatgacacttgaagagattaagcaacttgtccaggattccacatggagcagatgacagcatcaagatttgaaacgagaagcctgaccaatgctccttctggccagtagtcttttcttagcagaccattatgcacagttcattggtaaatatttccttagttgcatgggggtaggagaagtgataggagatatcccctctgtcatgcagcccagtctcatgacatgaggcaagatatggaagtggtctctggagaggtgggcccactcaaggaaatcatcaaagacttctgagagaatgtattggcaggggggtggggttgtggagtggctcttaggggttggttttgtgggataggaaaatgtttacaagacagaaattagaagaggactatacctagcagtaggaatggcctgaagaatgactttggtctgaggaataaatggtgagtctaggttttcacataatccatttgggctggactgttgtaaagttcaaatgtatgaatatgacttatatggactcctaccatggcctctgctcccttcttcccatcacacaattctatcacttttgctttactctttagccacagctttttatagtacctctattcttccatgctgtttcaactcaatgacactttattagtccattttatgttgctataaaggaatacctgaggctgggtaatttactaaaaaagagatttatttggctcatgattctgcagctctagaagaagcatggcactagaatttgcttctggtgaggtcttcagggagtttccaatcacggtggaagaggaaggggagtcagcgtgtcacacagtgagagagaaggaaagagaggaggaggggtgccacactcttttaaaaagtcaagagctcatcattacctcagaggagggcaccaagccattcatgagggatccacccacattatccaaacacctcccactaggccccacctccaacactggggattatatttgaacatgagatttggaggggacaaatgtctaaactatatcagataccattaataattttccttcatactcaaatacccttttccttgatgctttcttcatctggttcattgttgttttccttctaatttgcttctcccagaaagcctactttgctattctgggcaggtgatctctaccatacagttcaatagcaccctagtatgtattcactgctgtgcacagtgcttggcactgtgtaggaactcagttagacaaaataaggccaggcacggtggttcacacctgtaattccagaactttgggaggcagaggcaggtggatcacttgaggccaggagttcgagaccagcctggccaacttggtgaaaccgtgtctctactaaaaatataagaattagctggccattgtggtgcatgcctgtaatcccagctactcaggtggctgaggaatgagaatgacttgaaccctagaggaagaggtttcagtaagctgagattgcaccactgcatccagcctgggtgacagcatgagactctgtctcaaaaaaataaaaataaaaccagctgaaaagaactggatagattagatagaagaagctttgaagcagaggtcaagttcaaagactgtttctacaatgatcctagtaagaaccagggtatgtctgtaaacatacatgagggatatgaggaagaaagattgctgagagataattctggcatgtggacaggaatttcagacaccaaaaagatgggagggccttggattccacataatctaagaaatacgccctctgtagtcctcaaacatgttttgcaagtgtttggccattttttcataagggagtttttctagtaattggaaaatctatatgaggaattgcttccagttattcagcaagtcatttgctcaacaaatgaacacatgcaatgtactgtgtactgttgacagtacagcacaaggatccagggatgactaaggctcctcccctaccatagaaaatcccagagaccagtagaggagacaagtgcttgaaacaaatgacaaaagctactgtgttaagtagtgaatctcctcttttcctcaggcccactttggcctctgacagcacagggttgatgagtcagcctcttttcatgtgaaaacatctgtctggtccccccaaagacttctctaaacattcttctgatatgaggtaattatttcatatttgctgcatttgttgtgaacactgataatctcatgaagatctattaaatgtcaacgtgttcctttctgatctacttaactagttgatgccatctttagatgtatgtattgtagtagtagttacggaagggacttgtaataaacagatgcaatgataaattcagtaaaaacatagagaatcatttatgtttctcaattataagttaaaaggcaaagccttggtaactggattttcttccatttggggaaagtgtgatgtaataatccttcatttttaagaaataaagagaaatgggtggtttgttcagttcttgatataaagaagtcaactttaaagcaacattttattagaaccataagttttgtttgaaaaaatttaaaatccagagtttattttcctttggagttgctgcagagagtcaacaggaatcgagataattttttttcttgtatttgtgctcacttattaaacacatatgtgagctagattccttgcataggtgcaaaaggatttggaagaggggggaaggtgcaatttagttcattgacctgcttccctgccctcaggagtctttcaaacagctgtgagaaagaggaagaggggaaaggagtaattttgcactcatatccagatgttcatttcaaacgcatcctgaacaacttttgcatggtttattacattttctgaaaccatttttcacaagcctgttttctcagctgggaaacttctggtgtagaattttcaaaaaaatattgcatttggcattataagaaaaaaagagcttttgagacattcaaagaacaatctgttggccttggtctgcagaagcaggacttcaggaatgtaggcattttgtaccacccaaaatataggtagacgaaagatctattcttaacatttgctttacatggaagcttgagagatcctttagcttgatgatttcaatgatgtgctatcttaggttggcctgaaatatcacagaaaagaaacctagctggggacaaacaggaccagtggaagaatccatctgaacccaaaccaaaccagaagcttccacatggcacttcaaacacagtagttcagttttgcagaactctgtactattctagtcccacccatcttctgaggtaaagtgggaaagagtggaagaaaaatagttatgaatgctaattaatttcttagaagcctataggatgcccttcccatggttggtcccatccattccccttaagatccaggacctgacaacagaggaattgaggatctagaacagcccctagtcccaccgcagagtggacttggtctcctggccaattgcaggcaatgaaactcttccttcttcatcctttctacatgtggaatcaaacctagaaatacccttaggaaggagtggatgacccagaaagatgagtccaaatggaaagactaagatctgctcttaaagaaaggaaatcaagctgcagaggtcaaggaaatcaggagaaatgataaagcaaagttttaatgtggaagaaatagaagatcaggggttttagaacccaaaccaagtcttggatacgtttcttaaccttcctgacgttcagtttgtccacttttagaattgagcacgcacctacgtctttataccagagggtgtcaaaatgagaatggagtggtgtgatgtatgaatataccatagcataccataggtcctcaatattgtttagttcttcacacctattccccaacttagagaggtagcacaataacgctagacatccgtatttctgtaaatatttctgtcgaagttctgtgtgtgtctctgagatattaaagatattatccagtaggcagttggttatactaatggtgcagtcaagagagaatctgatttgaggatagagatccaatagacacaagcacaggggtgatggccgcacacatgagcatctatgagggcacccaagagactaaagggagtgagaggtaacaaggacataaaacagagttcccaggacaccagccttggagggacaatccacataagagaaccctgcaaaaacaaaggaaaagaacactgaacaaaaacaattaaagtagaaattaataagaacaaggccaagaatgcttctaaaagaaatgagagggaggattttctaaattttaaaataaatataacccaaaatgtaaaatactgtgggaaacaataacagttgtccaagaccacatattgcactatgaaatactgggaagtgaaaaaagaagtaaaaaaataaataaataaaatgtgctaagtttctcaactaaaataggactgagtcaaaagctattgtttctttttgaccttgataattagagaaatattggatcaagtacattattttgcaaaatttagtagaaataaaaaacaggatgattcctcccaaattactgcaggagattaaagaaatcaaagcagagttcatctagctaatgacaggaaataggggaaatggtaggaaagcataaaatccagaaaacataaaataagatcatagaaggaagtgcaaatgtgtctcttatgacattaaatgtaaattataatgccaccctttaatatttaggaaccatcagttcaggttaaaaacaaagatgcacctcttcaaaggaacaatttttaaaaagtgtctcagaaagtttaaacataatatatctggaaaatatgcatcaggaaaatgtaaataagaacaacggatgtgtcagtgttaatatcacatagagtagaatcttgggttgaaaaaaaaagatacaaaacagtacaagagttcatttatttgtagttatatattctattatggataaataactatgatatagtttgctgtttttaataacagataattaaatagatatataaattaatcttttggaaattcaaaggaaaatgtttgggatatgtacacacatatgactctcaactacatagtaaatagacaaaaataaataataatagatgaagttttcttaagatgataagaatataccaaacatgtattatacctagaaaatgagtactcatctggccagctatgtttcagatttttttttcctctgtaaattgcagggaactcttcccaggagcaacctcatttgctgggagatgtggtttccataaggatatgaaactatttcagtatcctgtcctgccatatggtcacacttatctggtgacattctggactcagcacaatagatgtgccctcacatgcaagtatacagccttttctagaaaaattttaaattcattttctatgaataatgtcaagctcttgagagactcatgaattctctaggttctcattttacaagtcaactcttggaaatattagtttaatctactttactgaaaactctaggaaaactgctcttcaattctcttttctagtgaacagcattccagtcttaatccttacagactttcggaggaactccctcacatcacccacagtagaaataacatgagaaagcacacagtcatctcttgcatccatgtcctatccatgcttttgcattgctgacaagtgacgggtgggctctgacatcaggagatgcaaatggctgatgattcagacggttgtttggtaagtaaacctgggtaaaccctcaaaatgcaatgtttattttttctcctgaccacaataatctgaaaataccctcaaattgtaagaatcattataaaacagcctttttctggctcactacccacataccagaattgggataactctactgaaaacttgcctaccctgataggaatggaatatttctgacaagcttacacatgttcacctctttctagcatcaccttcattgctatcatgtctactataattatcatgcattggcagccatgaggaatattttgcatatattatataaattaatctcccaataacattcaaggcagatactatgaaaatttccacttcactgatgaataaactgcccactgccacagagtaagtacacagcatagtccttattttaaaaacttttcatcacagaaaacatcttctcctcctttctccagtgaccctctgtgtgaactcctactcaatttctagctacgtgggttccctggtcatttcagggatgtttccttctgaaatagcttccgggtttataggttctccttatctctgttcttcagtgtcttcaagtggttatataactaatgagggaactcaccccaaatgcccttgtcacatgctattgggaaacatacttaaagcagggatgtccagtgttgtccttgattacagagattgatgggaatttgtttcacaagaagttgttttcttacagtatattgttaaaagctcccagggccaggagtggcaaaaatgccatttaaatgactcgccatgcttgttttattcaaaatggctacccctttatccagaaaatcactttttttggatcaaacatcattcttcagctcccttccattctttcacttattcagtcatttatttctaacatacttattgtgtgtattctatgagtcaggacctcttctgggtgttgggtgaacaccaccacattatactaattagtgtctacactaacaaagtagacatcactgaagacctcagtgaatttggtatttagtaaggaaccaacagacaagtttaaacctgaaacagaataagatagttgctctaacagggctatgggccagataggggagagaatcatcagataggttggaaacccacccatgaggctccttggctcacgtcctgcctgcctggctgaccctccaggcattcccggacatgtctgaatattcaggatgtacacattttgggctcccattttaggaccctgttggacttggaacattgccagtctcctcttggttggcactgtggtctaaaagagggtagaaagagagtaagttctacatgtggcagaatagaggtttcatcctcatcccctttccctgcttcctggacacagtggttacttatttaccccttatcttttggagctgggatcaatgctaagctagaattagagaacagtatcactggaaaaacaaaacaaaacaaaaaaaaaaaacaggaaaaaagaaggctgcaacgctgttagaataaaatacagggaaagtatagtctaggaagaggcaagtgttagctggtaaacgattttttagtctgttgagatatgtcagcgtgagattagtgaagaaagtgcattttccttcaccaccttctcttaactattggaccagggtgacttaaatcttctaagtgccttacctggcctctagtcttcctgatgcaatagtccttagaatggaaaatggtgataacaatagctattttttaattttatgctttattaagcacttattacgctccagactatactaagcattttgcctgtattatttcattatagcctcaaaatcacactgtggagaaggtactattagcatccccattttatagggcagtggagacatagaaaagaaaagcaacttgcccaaggcccaatgtgagtaaaaggtgaaatgagaattttattccaggcacttggaatctagagctccacactccactgaacgaatgtattctgtattctcgattatctcattttacttttaaatttctggtaataaactatactatagttttatgctcctgtaaggtatcaactaaagtgttaaatagaagcaaggtatcaagattgaggccttccatcatgagacattattgaaggtgcatcttcaaaagtttttgctttggggaaaactttagtaattacagtacaagacaaataatttaaaaccccaaaagctgtggatatgtaagtgttgagctttatttcttgtatttaggatggagcttcattccagtgtgagaatttatgccttggtgcgctgaccactccataaatctaaataaagcctcacaatgttccatgtactatgacaggtgggggatgcagagaatagtgagtaggagcataaaatctggagcagaaatggctgcatctgaatcctggtactactactgggtaagactgggaaacacactttcatgttccttgctgtcaaatggaggtaagatggcacttgtagggttgtagtgaaggagaattaagaacaatgttatcttccacaattattagacatagtttaattaccaggacatagtgcctgctattaaactggacatgaatgtgaacaggtggatacccagatataggtgtgaaaagagaacagggctttgacacagccagtggccagatttaaggaaaggtgtcagagacagtggggtgtaaagctgaattctcaaagatccacaggtgtgtccctgattagcaaggcaaaaggaggcattgctggtgaagggaacagccatgaaaatggaaatggcaagagtgaggccaagcagtcagtcttagggaactgcaaattaagaactatgcctggatttaggattctaatgggggcattgttagagtttgagtctagagagaaaggaaagcatttagatctcattaaggagttcagactttatgctatgggcgataggaatccatggaaaatccttgtttcatttgtttctgttttttgttcacttcttcttcttttttttttttgacagaatctcgttcctttgcccaggctggagttcagtggtgctatcttggctcagtgcaacctctgcctcccaggttcaagtgatactcctgcctcagcctcttgagtagctaagactacaggtgcacgctaccacacctggctaatttttgtattttcagtagagatggggtttcaccatgttggccaggttgatctcgaacttctgacctcaagcgatacacctgcctcatcctcccaaagtgctgggattacaggtgtcagtcaccatgccaggcctcacttcattgttttttaacttttatttttttaaatcaaaaagagcttttgaaaatttccttccaagtagtgaaatattgtgtaaacattaacttatggacaaattgcaagtcatattttaaaattacctaaaatcccacaacccagaggaaacacgcactgacattttcctgaacatcttagaacacacatatatgattttagtgaactgattaataatattttataaaatgcttattaataatatcctatggaaacctttccatatcaataaataaaggcctatattagcattttaatgactgtagagttctctcttttatggaggtaaagcagtttatttacccgatctttactgatttgaaaaaaaaaagtttaatttctgagcagtaagcagtgcttcaataaacaactgagaacacaatgcaataaaaccataaaataatggatggaatagataatatagcaaatagtttgttgaaaattaaaaaacaaacaaacaaaactcacttctttaacctgctgttgaatgagaagagaaaagaacatggccagtaccttagtagaggtttatttattcaaaaattcagtacctcatctcttatttattgagcatcaaagatgtgcctgaccctgttctgataatggggtgcaatggtaaacaagtcagagaagatacatttcttacagcttacattttagcacagggggcagatgataaactaataaagatgcaagaacatattaggtagccatgagcactgtggagagaattaacacagggtagtacaacagactagaggatcacatttgttgggtcacctgaaaagacttctcttaggaactgctattaaggctgacaaatgaatgaccaaagaatccaggcaggtgaagatcagggaaaagtgatcttttctattcagggaagaagaagcagctactgcccaaagtgaaggatgtacttagcaggttcaagaaagagaaaaacaggggtccactagtgtagcttgcaaatattcaccaacaggaaaggtggcatgaggcacagggaaggtcagggagcatcctgtgggccaggcaggtgttcagatgtttctcttacttacaatgggaggccactagagagttttcaccagggcagcaactttatctaagattttagaagttcaattcagcctccagaaaccacagattcctaagggtaagttgctgttttgtttagctctgcattcataagacctagaaaagtacctggcacatagtagatattacttcagtgttaaaaagaatgagcagccgttaggtagggagtccaacacagaggaaatgaaagtggaagcagggattcattcattgatccaacaataattacgaaatatttaaaggcattgtactaagtattgtgggtcaatgataaatgaaacttagtccttgccctcagagagcttatattctagttggtgaaaaggacctgaactgaatacatgggtgattatttatttctattgtaagtgagaacaatatttcattccaagaaagggcatgtcttattttgatactccagactgttatctatttgctttaaattaatttaatttaatttaatttaattatttttttgagacagagcctctcactctgtcgcccaggctgcagtgcagtggtgcgctcttggctcactgtaacctccacctcctgggttcaagtgattctcccgcctcagcctcctgagtaattgggattacaggcgcttgccaccatgcccatctaatgttttatatttttagtggagatggggtttcaccatgttggccaggctggtctcaaattcctgacctcaagtgacccaccagcctcagcttcccaaagtgctgggattacaggcataagccaccatgctcaggctatttgctatttgattgaggacaggccacagctgtagcctctgtttagcttttcaaggagaaaatcaggtcttccactgaccagaacatctagaaggaaaggaatatttaggagaaaagattatcagccaagattgggatatgttggcttcttggcacctttggccccatgggtgcagatgagcagtggaagctggaccttgcagtgtggagctcaggcaagagagctggagatgggaacatagccatatgggggccaagtatagacaagggaaaatgcagtggtgtaaagtaattttcattattttccttctatggcctagttagattaattgctccttcaacagttcctacagagacctacgatagcatttaaagagcaggttctctggacttgggctgcaatggtgagcaccagagcattgtcacttacaatagaatatttatgagcaagttgcccagccccttggggtttagtctcctcatcagcagaatgtgaataacaatagcacctactctatacaattgattacattctctaatatatttacagccctgagtaatattgaagccttaataaatatctaatatctttattacattcagttgtaattattttattataaggctgtaatggcctactctagaccatcatacattgtgatcacttatgtattatcgatggcaatcatagtattttgtaaaaagtctgcttgataaatattctttgaattaatatttttaaaacacctttttggagatatgattgcacatacaaagagccgtgcatatttaatgtatgctacttgatgattctggacataagcatacattcctgaaaccattaccgcaacgtatgccatgaacatatccatcacccgcaaaagtttcttcctggagtcccaacttatctaaagtatagggaagccagggaaccccttaataactgaggatatcatgtacaagaaagggcataaaaatacgggtggcatgcactcctatcattaaagtcaggatccaatatatccttttaacaggagggttcaggtcaagttttggcagagtcaagtatcatctgtggattcagggctgggtgaatttccaatgccaagtgtttagaagtgaagctcctgcaccacctgtatcacagtcccgtgggtcagatgatgctgtctggagttcagaatcctcagtttcactcctgatttactgattcacaacttattgatagggggtgaggaagagaacagcctgcctagaactaccttaacagtggctccctgtatgtgccataaaattctaaaaatggaggaaatcaaagagatttaaaaaagcatatttgaatacttgctgatggaaattatttctggaggtcacgacataggctgggactgtgagatcctggaatcggtgtttgtcttcgtgtagcagtgtttcttttttgagaggacatgggaagtaggaagcagacaatgtctcttggtggcagtccgagttggcagggagccccttcttctgggcaaaatttctttggggcctacagagccctctttcagtcttgaacaactcacccgtgagatgggtcctgtccgctatcccgtgagagacagcctgtgattgttgttggtctgtgccagttgcagggggtataatttagttggatttcaaaagaagaatttcttttttcttttctatttttttttatgtctttctctcatatcctaatggagtttctgccaaggcaaactggtacaaaccggcgccatcaggaaagcaggagatggagcccagttctctcgaacacttcatacccaagtgtattctcactctaaatctgtatccaacacttagtcaagcttggattcctataaaagccttgtaaaaaggaagtatggatcaaagacaccttcaacatgtatcatgttgtgttcaaaacctgtgtgggagaagcaagttgtaagcactagcttctggtcagcacttcccctgagtctccccatgcagggccctgctgggggccttctaccaagacatgtcctctgagggcctctgccaccgtctcagccttatgtttccctgggaaaaagggcaggagcagccccagcagaggcccttttccctggcagcactctgtgtcagcaaagcgtctccagcaagtatttccgtgggaaggtcttccatctggagcttggcagacagaggaagtttcctttgaggttctgccaccctctcccctcagctctgcataaggtgcagcccagagaggcccagactgattttaggaagggtgcgagtgtgtttcatggagtcagaactgctgtccctcttttcctcagtaagtgggcagggcgctgagaagaagaatgttgtttgttctgccactacctcccatctcagtgtgcaacaggtcacaagatgtgacaagttcatgtgctaattccttccttttcagttaatagaataacacagatgggaacacttagcctgggatcggacacaaattggagcagccgtggaaggaagatagaggtagcctggcccattctcagcacttcattaaacagaaatgacttctaacagcattgttaccctcagctgggtatccctgagaagctactctgacaggaaggtataggcctctggcataggccctagcctcaatccactcatcccacaaaatgctcacaacatattaaaaaagtaataacactagacagcaatttcactgcttcccagagtcgctgagcagcaacgccctgacattagctctaaacctactccatagcttgtctgcaagacgataaacagaatactaaggagaataggggagaggagtgttgagacagaaatcgtagagccaagcacagacaccacggggactcctgtcatccaccttggccactgtgcatcttgaatgttcaggtatagaactggtttcaaatattttaccccttaccagattatgttctagcttttctcaaaggtgacagcaaacctttggtgatcaaatggctttggaatcaaagagacatctttaaatcccaggctgctattatgatgagctatgagtgagtacattatccagctcttcctaagactctagtttcttacctgtaaaataaattaggacaatactttcctcttatttagttgttgaggatcaaataaaatgtctagagcagtgactaagaccaaaaaatagtagctacaatgtattgatgtgtatgatatgtgccaggcattgcacctaacactttataggcatattcctaatttaactttgctaaagtgctctgaggcaatgctattataacctccccctccatgttacaaatgaggaaagagtgcagtgataagatcccacaacttgcaagttgcgggggaagggtcttgaattgaagccaggtctgtctatctgtgactttagagcctgagttcataaacacatagtaggtgctcagtaaatggtatctgtaatcattttcaacattttcaccactacattacccaaatcatgagagacctccatgccttgctaggcagtttgtgtatcagcattgtagcgttggctataagaagatggtagtaaaataggagatgatagacaacaattcctaatttggaaattgttttggaaatttaaaaagaggatgacagatgcatctcagaatttagatgaggttaggtccaaaaagtatctttgtgaatatgtgtaaattaatgcctgctttgaaccccttcctcttttttatgaaaacaggataacagcctctcctccctcttgagaacttagcctttctctattccatgtggctttgatgagaataattcacatttttcccttggcaccaggttacaagtgtgggccacctgtcatgaaccttgtctatagagatcagtacataacctgagcctatgacccaaaagggccaattgagatcattcaagaagatatcatatgttgataatagaagggttcattcagtcaactctgtctcctgtcactgtaaggctgaaataacataagttgagcttttggtagccacttctgcttctctcttttcaaataaatggaggtattttgcagtcggaaggaattcaacaaatatagggaaagccaagaaatgcagagagaagtagaggaggaagaagaggaggaggaagaggaggaaaaagaagggaaaagagaaagaaggaaaaagaaaaaagggagggtgagaaagccattattttctatctcaggatcgccttgtgtttaagatcagttctatttctagatttccatgttgtgttttcataattttacagaaaaactactagtttgcataggatacattggatttgtaagcaaagaactaataacgagcttggtaagaggagttttaatagcctcggtatgaccaaaattttgggttatcttagactttctcagtccccattcccagaacatttgactctgtctttaccagggacatctagtagcatatcccaattatgtttcaattggctctttatttcagttgcatggtgtgatggaaggagaatggtctttgaaagcagacagacataatttcaaataccagcttttccagaatgtaactctatggatcttggacaaattatttaagttctctgagtctccatttatcatctctaaattggatgtgggtacttgggtgtgagaacaggtagatgggcaaatcaaatgacttagggttaaaaaaaagtccctggcatggtgcctagcccctaaagtgtactctgaaaaatgtgtgttgtattctatccagctcaactccactctttccgtgtgaagattacatagtaattgagaataggtatgttaaatctttttgtgatccttaggacctttctgtaatacagaataatgatgttgctctgtatagcatatggccatgccatgtaaaatgttgacaaactcagcctcaacttttagaataagttgcacaaattaacaaaatatgtgaagtcttgaatttgtttgctaaaggagcaattatatttcatacataactgacacttcactactttctgtcttgtagtaacagcttctagtaactcacagctctcactgtccctattcctggggtgagggaggtgatgatatcatatattttctgatctcaggatacatctagccatgaggataccagggcaggtcccaagacactttactggtaacagttcctccttagccctgctagctttctttaaaaaaggaatcagtatgttacttttctggatttttagggaatcttatagttgaagttggttttgtgccatttttactttcatatcctctatagcagtctctctgtctctgtctctgtctctctctctctctctctctccccctcccaccactgccttgccccgattctagacaatgggaacaagattgaataagatacaatctcccaccccaaagagccagtagtccctttgatgacacagactgagagcagtttatgatctctacttctttagcttgcagccaaggaggtggagccgagacccatggctgagtgcaggactggttcctcagccctggagaggtgacattaaagggtgtctttgcctcacatggtgcccagatgcctccctttgtaccccataagctggttaagagagaattatctttctataaaagcagagagacttaatgcctggcagaccctgaatgtaaatttcaaacgatgtgatttaagtaaaacttatttaaagtgaaagttgtggtcacactgaagacacagcccatctttgttttttgccttatacaagtttatgtggaattcctttctttcccattctttatacccattgggtataggtattctcttggctgactcagaacatttatggagaaaatcagaaacagggcttcatctcttctcctaaaaatagtttctctttttcaaataaacctgctggtaaagtgtttacaagtataatatttcacacaaggaggaaaggatcatattaactgcaagagagaggaatctggcacctaattcaagaaacatccttcatacttcttgggattggaaatacaaaatccatgagcctagaaaagggagggattgagtagaacacaggaatctaaggaaaattatagcaagaaagggcttggatcaacccttatctgagtcccagtattttgaggagtgtgtttatccatgacttgccattttgaatccaaaggtagttttgtagtttttcctttttctccacctagggaaataaattgatgctcatttagcatatactatgttttgaaagaaaggaaaaagagagagagaatattaatttgtgtagcacctcatgtgagtttctacagctcaaatttccttggcaaatttattgtggagtttccacctatataaaggaattttccttactaagcatttcccagatctttttcagtctctgttttcttaatttcctaattttaaaaattgtccaccagggaccaggactgagaggacaaaatcaacagaatgaggccatgtgggatttggttgccaagactcaagagggtcttgctcttgttggagcctcaagtccaacaacggtcttggtaacaaaacacaaacagttcccttgacacttattggaagggggagagtggggtgtgggagcaattggcttgccttctaaaatgactgaaagcaaaatttgagtgaagccaattaaatccatgagtataaagtaatttttgcaagaccttcccagcagagagaagcagtcatattgaagatcaatcacagaaaaccagaagcattttgaagtggactcattaaatctaacaaggggttttgggatctgggacggaagaggacagcaaaagtcttttaaatgtaatgtttgtcctggtgagtctggaggctatgagagctcctgtccttatacacttgtgaactagttcaaaaggctaggtgaggaagcaggaccaaggctgcgccatgccctgggagagaagaggaggcagaatgtaaggaccgtggggccaaagtgggctctgttgcaggctctgaggaaggagaggcaatattcaattcagaggcatgatgaggcttgtgcaagcctggccactaaccaagagccaagatgagctgggaggagggaagtccaattgaccagcccatttgaccttgggtatgtgggaggaagacaacaggaacaccaactgctactgggtcaagtaccctctgaactgagacagcgaaaacaggaacaaggccagcagaggcttctaaagggaagcaactgaatctggaactgtgattagtcatggtatagagaacacgttcactgattcatgagcatgtattgattgcctactgcattctaggctctgttctagggacacaatgccacaagacagtcaagagggggagagacaagctaagcaacagccccaaaataatgtcataagtagcatgaaagagaagtgtagaggaaactaagaatatgcctaattagtcttattagtagagaaggcctccttcctccccattgacactaccctcatttagacggctgtcatttttcacctaaacattgcaactgttctacactgatctcttcacatcttctcatgcacctttccaacacagctgatcatgttacatgcctacctacctaaagccctttaatacatcccactacaaggcagatgcaatcaacattctttaatatgaccagcatggctctgctgtatctgtcttgtctctttctccaacttattttcctctactccgtcatgctctctgaaatgaggagatgctaaggaaaagacatccaggcaaagatgtgcagaaaagtaacaatatacaagagaaaacttagggagtagacaaaaaaaaagttctctctaaaatccactttctttcatactctgagaaggtttggtagacagaattctaagatgttcccacctcaagatttcctacccctggtatacacacacctactccaagttattaaagcaaacactaatctagctgcttctgtgaaagaattgtgcaaatggagtcaaggtcccaaatcagttgataggaaagttatcccagtgaccctgacctaatcacaggagcctgatataagcagagcgtttcatccagcatcacggaagttggagattcaaagcacaagaaagactgaaggcactgttgctggcttgaagatggagggaacacatgacaagaaatgcaggcagcctctaagagctcagaatggcccctggctgacagccagtgaggaaacaggggtttcagttcagcaaccacaaaggaatgaattttgccaacaactggtgaacttggaagaggatcccaagccccaaacaagaactccagcccctgccttgttgacaccttgatttttgctgggtgaaattctgagcagagaatttagttatgctgggcccagacttctgacttacataaactgtgagataatacacttgtatcatttttaagctggtaaatttgtagttacacagaaatagaaaactaatacttgaagcaaaagaaaattcagctttccaaaacatttaggcatataggacttaagtaagtgtcctcctcatcattgaccgatgccccattctgagatttttaatccagacagttgcccaaagcatgaagaggggatgtatatcacgtgtgtctttagaaacagggcagggagtagttctactcttaactgcaactcacagttgaaagtccgatttcttgtaatattgatatctgtgttctttctggaatggaaggggtcgcagatatttagattatttttgtgaccaactaagagtgggtaaaaggtgaaaatgggctgaaagctggtattagagacatgggtactacttacctgtagaataagcaaataactgccttaataagtaaacaaataacttctaagtttaatccccaaaccacaattctataagttggcatacaccaaagtattgaaagttgatttggaagtattgacatagaccaaagcccaaagtgcttgtagaatttgaggggagaaccagagtggcatctcttggcagatagcatggaagggagacctacattccccattagaaaggaactgggctaatgttgacatctgacctgtagcaatgttctcctaatacacgtagcccaagaaaagaaagctctttgtcaactgagagttgctggccacttgcctaatcaccagccttgcttgctttagagaaatttattaccataaaaaagggacaaactgtaaaactcagacttcagtgttgaaaaattgttaggcctttggcccttttctcagcatttgcaaagaatttccttatatacttagtgatggggttagatatatgtaccttggagaggagcacttgtattggagcttttccttttaatttttcttccacttttaatttaggttcaggaggtatatgtgcaggtttgttacatgggtaaattgtgtgctgctgaggcttggtgtatgaatgatcctatcaccaaggtagtgagcataaccttccaactcattccccactttcattttcccccgtcaagcagtctccagtgttcccatctttgggtccctgtgtattcaatgtttagctcccacttataagtgagaaagtgccacatttggttttctttctttcacagcaccattcacaataacaaagacatggatggaattaacccagatgcccatcaatgatggactggataaagaaaatgtggtacatgtacaccatggagatttttcaaaagggaaactgtgttagaactgagccgcctcctagtctttccgaagaatgtatcaagagaacttttgttggtgtcagaaaaggcatgttggtgtcagaaaaggcttcccatgaaggcaatattggggctgggaaaaatgttcatatgtcagacaagagaaagctaggacaatctagtcagaggttgcagaaggtgtaaagatggtggcatgaatgaccgtggaggatccaaaaaactgaaagtcagtttagtatgcttggagtacattatttagtcaatggcagaaagagaagatatacaattggagatgaacttggaaaagtaggtctgactcagagtcaaggtaaccttgatgctttcctgagcaggctgggcattagcctgtaaggaccaaaggatttttgccaatggcatgatgtgattattctcattttggaatgctgtccatgagggtagcagtgtgaagaataaattgagatatctaggatgagatcccatttctggtttggccaatgtcttgaaatgagataaggaattaaattgggagtcgggggggatatatttagtttgcttttggacatgttaaattgtgtttgcctgcattacacaagtgaatatgttgtgtttctgttactcaggacatggtcaataattggaaattcagactggagagctgtcacacttagcaggggcagattcatgagcttgcctagggaagcaggtagcatgattgtttattttttctgtaaatcaggatactcctttagtttattttacatagatcaatcactcttgaatttttgttagggaaggcactcacttatcaatcatcaaaaatttaatgtgatccttccataattggcactgttcagacatcaatggtgttgtagaagacaagatggaaaaaatccctagcctcatagagcttcactccacaaaaagatgaggaagagtaacaaatcatagaataaacaaatgtcagatagtggtaagtgctatatagagaaataaaacaggttaagcagatcaaacattgctatggagataatcgttctattttagatagtttggccctgtaaattgtccctcaggacatgacatttgagcaaagatctgcatgaggcaaggtatgagccagtcaaggtctaaaggaagagaaagcggagtctgaaaggtatgagtcaggaatcagacattcaaggaaatgaaagaaggttaagggcagacagagatatgtgaatgaaaggcagagaagtaggagatgagaatcaggcagacgactgatcataacagaacttggggctagggttagtgagtttgggtgagacagaaaccactgaagggctccaaacaaagcagtgatgtcatctaatgtttatttgaaacaattttattggtatccatggttaatagggagtgtgctaaaagattaaaattattattattactatttacctgttcagtcacccactcatataatctagaaacatattctgaaagcctgctctatgccaaggattgtgatagacattggggacacaaaaactagtaagaggcagtcctttccttcaacattttgcagtattacaactaagtatgcatacatcacacttgacaatggagattcttgcacccacttcccattccatgccgtttaccctatacaccggaggtagaattatttaaacaccaagtagcctggcatatttttagcatcttaggaagaccctcactggatttatatattttattatgtagttattcccacttctcactctcactctccttctaatattcttcatgtatctagtttcatttttataacttctttcaaaatgtgtgttctagttttgcagtgacttttatttctttcaaaatatatgtttcagaccagcagtagagagtgtatgtaattcattagattgtatatgggggccaagagtctacattttaggggaaaaaaaggtccctgggtattgttgatacctaccccagctcggaacttttcaaagcgggaggtactaaagttcattgatgtgtttgtaaacttactcctttgggggaaaaacactctgatttgtagcatttgctgattttcatggtgcgaatatttccaccatgaccaatcttaagctaagaaagatttaacaaccaggctgcaaaaatcctgaatagtgagcaattggctggagccaatttcagcatactgttgttatgtcttcaatcccacctacataagtacctaatgaagacattactctgctcgtaagaataggtcatcttagtacaatgtgtcctaaacaggtaacaggaactttcagtgtacctagataaagtcaggtaggtgttgcagaatccctgataagcccgtctaaaattgagtgacagagctccttttctttcaaggatagtttttaaagtttgttactgggtttctcatgtgcaccatgatagaagccaactgttttgtccttacactctgaacaattcctagacaaattagaaggatgcctcatggccattctattgcctcagaaatgtttgccatccttgggttacattgtttactggagccaggatctgcaggtgagaactgaagagtacagttgggaggacaatggatcttgagaatttagaagatatttggattttagaaagtcttggaagagaggagctgaatcatttctagaagattcaaaggttgcttcttttgagtagtgcaatttccatatgggcttgtgatatcttaaaaatataggtagtcttcctcctttaagactataaatggttaaatgcagttactgagaagtaggcatcatcatcatcatcacagtctaaacatcttacatatttaattgtgaggattacaatagagaatcttgtaatcatcataataacctgataagtttgtcttagtattttctccatattataaattaggaaatcagactcagagaagttaaggaacggatccaaaaccatgcaagatggcaaaatgtagctggggtttgaaaccagactacctgtgcccagagctctcattttccctgctctgtcatactccttcccaatggtcttcatggtgcctgatccatagtgggtgctcccaatatatttatgcaatgaataaaaataaataaatgacagtgtgacttctaagagaaataattaagcttggaatatatagatttttagagtttttaatgtaatgaaaggtcatgtatataaagccacagcaaaatgttctgctatgaaccttgaaaattgagttcttccttggaaataaaaaaaaaaagtgtgagcttaaggtaattgtccttttatactgttgtacttgtcatagtgccagcatctacacttttcctctagagataaaattaaaatgccaaattttcatgattatgagatgattacagaataagtgctgatggaagaatcatgaaacagaaaggagagtctgtatgccttcccaactagttaaggacttttttttttttttttactttgctttgctttcctttctttttttttccctgcaagagatatactacataaggattttcttccatgttcccactgtatggactctttttctctcgattattattcaccctctgattggttgtgacatgtgtctttagacaggaacacttgtgaatgctccagcaccattcaaaaggtagttcatcccagctggactgaaaacactaggaaagtttcacattgaaggactgttgcttttgttgtaataaagaatacatacttttcctactaccaataactcttcccgtgattagaaaggattcttcacaagaaaactttggccaatgtgaaaaatgaggtttccattacatatgtcaatgtaattgtcatgtgaagtttaactgtcccgcttgtttatttgctcattacatctaaagggaaagcaatattgtgggggggacaatcaggtcctgagtgcatcagtttaatccagagagcttatttttgatttaaaataaaaagcttcagaaagagaactgcagacgtagaatccatcctttgctcttttgtttcacatttcagtgggatgcagacagacctgtgaggcatgttgcaaaacaccagcaagagatccaaggctcactcctgaggctgactctgattagacccttgctaaccacagttcaagtagatgaaaagggtgagtgtattctgatggaattctcctttggttttccctctggggctgatgggaggggacaagtccatttgtcctgttttacaagtgcgatgtcttttgctcttaaaaaggaagagcttgccacatgccatataccccactattagtcaagcagtggaaagaactcaatacagactaaaaagtacaatgcccaaagggacaccatcaatcctttattaccacaacttcctcattcttgagttgtttatattgatttatcttttgctcaggtagagtgacttagagtaattttctcagcaagagaacagggatggcctctgttctgagcctttgccagcctgagaaatatttccctctgccctcatacagaataattgggcatggaattttcgggccataatcttttcctctcaaactctgtagtttttgttactaattttgatcttagccaaaaggtgaagaagcaatgaattttctgtttgttttttttttttcagacgtgtgtggcatatagcaatatatgaagctaagattatttggaatgtattttagtcaacctaacttttattcccacttctatttaaagtgtttaggctttatatttgaagtgtcaccatattacttgaataaatctcaggttgtaattctgtgtttttttttaaattaattttgcccaggatcaataaattcttttagttcgcagattttttttcttttactcaataatgtttccttctattactcctttaattgcttctggtgtgtgttttttaccaaaagagaggtttctctgagacacgtcttttatgtgtctgtgtgtatagatagatagatagatacatagatagatatttttacatataaatgtgtgtttatatacaaatatatacaataaaaatatttattgtatacttagtatataaagtatgtatatatctcacacaatgcaaacgcacacacaagtatatatatattctattatgtatatatggtccatattcccctaggctcatcattatttgtttttttctaagtttcaaagtttttttcctttatctttaaacgcttctgaattcctataatcttttttcttctgatacacatagttgtttgcataaaatctgtcatttaccacttttacgatctgtcatttaccacttttacgatgagtccttaattcaaaaattgaagcaataatgtatcctttaatttcttcccttatctatctttcctgattttagattgtttcacttactgtatgcttacttaatttcacaaattctatgtgtcttctagaagtttaatcagaaatgttctcaactttctatatttaagagtttttctctgattcctgggaactggtaaaatgtagaggtttgctcttgagcccatttgatgagcctgtttctcaagcatggattgctttcacaggagattggaagagaaattttacccagtccctttgttctctcttcttcttctctctggttcttggttctgctattggttcttctctcagtactgtctcttcatacttgtacaattcctgagtttttatataaccactaaaaagttgttggcatagaaaagacaaagacccaaccactcctctgaggggttttttggttgttgtttattttctagatggaaatgtaattttgggcttgcttcaaatgaatgtagtaaccagaagaagccctgtgttctagagagtgaactccagaaacaattttccagaaaacacatattttctataataaagtattaaacagcaaagcgttcaagataccaagtatgtttatttgtcactatggacgtaaattctgtctcattaaatgataaagttcccttcttttgagatgtgccctttggcccatgccactgtggctgctagtgtataatgcaagaattagattatcagcacccattggcatgtctcagttttgtcttatgttgatccacgtcatgtaagtatatgtgtaatacatagaaatagcaaggtagaacttagttttaattactgtatgacttatattagtatttgcctcatgctttttatttaactaatgactcacagatgctccttttcatgttatttgaattttagaaatttatctatgctatctttcacttctaagtgcaatcatctgcttgtgtcatgcctcttgccatgttccactcagtagatgtcaaaaattagtctcttgcttctctagttattttaattgtgatgttagggtgtcaattttagatctttcctgctttctcctgtgggcatttagtgctataaatttctctctacacactgctttgaatgtgtcctagagattctggtatgttgtgtctttgttctcattggtttcaaagaacatctttatttctgccttcattttgttatgtacccagtagtcattcaggagcaggttgttcggtttccatgtaattgagcagttttgagtgagtttcttaatcctgagttctagtttgattgcactgtggtctgagagacagttcgttataatttctgttcttttacatttgctgaggagtgctttacttccaactatgtggtcaattttggaataggtgtggtgtggtgctgaaaagaatgtaaattctgttgatttggggtggagagttctgtagatgtctattaggtccacttggtgcagagctgagttcagttcctggatatccttgttaactttctgtctaatgttgacagtggggtgttaaagtctcccattattattgtgtgggagtctaagtcactttgtaggtcactaaggacttgctttatgaatctgggtgctcctgtattgggtgcatatatatttaggatagttagttcttcttgttgaattgatcccttcaccattatgtaatggccttctttgtctcttttgatctttgttggtttaaagtctgttttatccgagactaggattgcaacccctgcctttttttgttttccatttgcttggtagaccttcttccatccctttattttgagcctatgtgtgtctctgcacatgagatgggtttcctgaatacagcgcactgatgggcttgactctttatccaatttgccagtctgtgccttttaattggagcatttagcccatttaatttaaggttagtattgttatgtgtgaatttgatcctgtcattatgatgttagctggttattttgctggttagttgatgcagtttcttcctagccttgatggtctttacaatttggcaagagcaaacacattcaaaagctagcagaaggcaagaaataactgagatcagagcagaactgaaggaaatagagacataaaaaacccttcgaaaaatcaatgaatccaggagactggttttttgaaaagatcaacaaaattgacagaccgctagcaagactaataaagaaaagagagaagaatcaaatgacgcaataaaaaatgataaaagtgatatcaccactgatcccacagaaatacaaactaccatcagagaatactataaacacctctacgcaaataaactagaaaatctagaagaaatggataaattcctcaacacatacactctcccaagactaaaccaggaagaagttgaatctctgaatagaccaacaacaggctttgaaattgaggcaataactaatagcttaccaaccaaaaaaagtccaggaccagatggattcacagccgaatcctaccagaggtacaaggagaagctggtgccattccttctgaaactattccaatcaatagaaaaagagggaatcctccctaactcattttatgaggccagcatcatcctgataccaaagcctggcagagacacaacaaaaaaagagaattttagaccaagatacttgatgaacatcgatgcaaaattcctcaataaaatactggcaaaactgaatccagcaacacatcaaaaagcttatccaccatgatcaagtgggcttcatccctgggatgcaaggctggttcaacatacgaaaatcaataaacataatccagcatataaatagaaccaaagacaaaaaccacatgattatttcaatagatgcagaaaaggcctttgaaaaaattcaacaacgcttcatgctaaaaactctcaataaattaggtattgatgagacgtatctcaaaataataagagctatctatgacaaacccacagccaatatcatactgaatggacaaaaactggaagcattccctttgaaaactggcacaagacagggatgccctctctcactactcctattcaacatagtgttggaagttctggccagggcaatcaggctggagaaggaaataaagggcattcaattaggaaaagaggaagtcaaattgtccctctttgcagacgacatgattgtatatctagaaaaccccattgtctcagcccaaagtctccttaagctgataagcaacttcagcaaagtctcaggatacaaaatcaacgtgcaaaaatcacaagcattcttatacaccaataacagacaaacagagagccaaatcatgaatgaactcccattcacaattgcttcaaagagaataaaatacctaggaatccaatgtacaagggatgtggaggacctcttcaaggagaactacaaactactgctcagtgaaataaaagaggatacaaacaaatggaagaacattccatgctcatgggtaggaagaatcaatatcgtgaaaatggccatactgcccaaggtaatttacagattcaatgccatccccatcaagctacaaatgactttcttcacaaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtacaaaaacagagatatagaccaatggaacaggacagagtcctcagaaataatgccgcatatctacaactatctgatctttgacaaacctgacaaaaacaagaaatggggaaaggatttcctatttaataaatggcgctgggaaaactggctagccatatgtagaaagctgaaactggatcccttccttacaccgtatacaaaaattaattcaagatggattaaagacttacatgttagacctaaaaccataaaaaccctagaagaaaacctaggcaataccattcaggacataggcatgggcaagctcttcacgtctaaaacaccaaaagcaatggcaacaaaagccaaaattgacaaatcggatctaattaaactaaagagtttctgcacaacaaaagaaaccaccgagtgaacaggcaacctacagaatgggagaaaatttttgcaacctactcatctgacaaagggctaatatccagaatctacaatgaactcaaacaaatttacaagaaaaaaaaaaacaaccccatcaaaaagtaggcgaaggatatgaacagacacttctcaaaagaagacatttatgcagccaaaaagcacatgaaaaaatgctcatcatcactggccatcagagaaatgctaatcaaaaccacaatgagataccacctcacaccagttagaatggcgaccattaaaaagtcaggaaacaacaggtgctggagaggatgtggagaaataggaacacttttacactgttggtgagactgtaaactagttcaaccattgtggaagttggtgtggtgattcctcagggatctagaactagaaataccatttgacccagccatcccattactgggtatatacccaaaggactataaatcatgctgctataaagacacatgcacacgtatgtttattgcgccattattcacaatagcaaagacttggaaccaatccaaatgtccaacaatgatagactggattaagaaaatgtggcacatatacaccatggaatactatgcagccataaaaattgatgagttcatgtcctttgcagggacatggatgaagctggaaaccatcattctcagcaaactatcgcaaggacaaaaaaccaaacaccgcatgttctcactcataggtgggaattgaacaatgagaacacatggaaacaggaaggggaagatcacacaccggggactgttgtggggtggcaggagtggggagggatagcattaggagatatacctaatgactaggtaattaactagataatgactaattaactaggtaattaactacataatgactagttaatgggtgcagcacaccaacatggcacatgtatacatatgtaacaaacctgcatgttgtgcacatgtaccctgaaacttaaagtataataataataaaaaaaaggaaaaaaaattaggctcacaatcaacaagctgtattgtacttttaaatacattttataatcataaacatgtattttttttctgagcacctacttggtgaaaagttttagaatttaattactctgtcatccaaccaaggaagctttcaataaaaatatagacactcaaggagaagttaggcatcaccatgcttcttctttctggggaaacaagatgttatttggtcaaagatttttaaattgaccctaagcttcttcaataatttgtaaatacccagttgcaaagagaatgtataaatgtctatctaactctgagaagcttggtgtcatagggaaaatgctagtttctctcttgctgcattctaaggcagagcgcactgatggccaaagggaatctggctgtagcccaaacccatttctctaacttccaaaccagagaggacacactctgcttccaatagcccatccaacaatgatggaaccatggctgatgggaattatctcaaactcatcaggaatgaacacacacttgctaatgactaacttccttcccctccatgtgtccctgcagaggaagtaggcaagagagagcaagacccttggctcaacttcagccttttcccctttttcctttcccaaataccctctcctctcactccattagcattcttgattcttgaattcccatcaagttttcaggggaaggggaaatactatttcttgcactttttgttggcgaagaaactgatgctgtctgcctttcattgttctacccagcatccggtttggacttgactgagggcagtgatgaaggtgaacatccagttgtgtcccatgtcctttgaacaactgtctttacacagacaaaccattttggagactgtttatgcttacttgaagtatcagtagcaaactcactgcattacccccagtgagggccactgatggcattcaaaaagctgcaaaaacaaaaacaaaaatcaaactcataactaaaaaacccacaatgtcctcaatatattgattaaactttctgtatgactatagacatggaggagaagaaatcaacagagagagagaaataggctctagaaataggctctgctttcccaacagcaacaatggttgtgccttatcatgtgaataacaacatactagagttgaaccatcatactattggtatatagtaggtgatcaataaaatagttgtgaatatcagtaccatatttgcagtatacttgcctttctaggtaactggatctaaaggataaataaagtacatctaacttagaactgaggagaggtaaattgtactctttaggttatggaaatatttttaaataaactctttcttttggaattatctttgacttacaaaataattagctgagtacagagagttccatatatttctaactcagtttcccctaacgttaccagcatatattagcacggtttatttgtcaaaactaagaaaccaacattggtactttactataattctagattttatttaactttattttaatttcactagttttcccatttttttgttttgttttgggatcaaatccaggctaccacactgcattttgtcaccatctctccatagacaactctggttagtgacagttatttagtcttactttgtttttcataatcttgaccattttgaggaataatggtaagatgttttatagaatacccctcaatttgggtttgtttgattttccttatggtttgactggggttttgaatttttggatagacgaccacaaagttacatgatatccacatgatatcactgatgatgttaacctttatcacttggttaaggtactgtctgccaggtttctccactgtacagttattatttttttccttttatggaatagcttctagtttggatatattataatttcatttagcaagtctttttatatagatcaggaaatggttctttattgtgaagttaaaaagaaaaacaaaaaagaaagaaatgtcttgctggaatcctggagaaagtttggtcagtacttgattttggtatcaaaatcacccaatccttgtggaatttgaaagaggttaagattgtagctgagagtctaagccatgcaacttctctctaagctcttatcatgagcacagggtctgcacaccatcttccatgggcactgaagttaacagagaaatccttccacccccacccagaccttttccatgttcttctctttaccatttctcatcgtctctctctaaccttccattgtgccctctgacaggcaaggccccatctccccatgttgtgtcctccttcacggatcgtcagttacttctgtgtctagttcctaaccttcataaaggacagaagtgggcgggggttatcagatgctgagactgtgggagagagaggaaggtggccctctttttggcctgctctctggatgaagtatctacaatacaactagacctttcacaatgtggaaattacaacttctgctagcatatctcctaatttcacgatgtttgaagaggatttgcctccttatccatcttgaattactatgtaattctatttctattaatgcagtattgataaaccactttccaaaactggaggacagaggtcataggggttaaaatgaatccttccattttacataggtcttgggttaaatatcattggaaaaatatatttatttatttttagtttttgagatggactctcactctgtcacccagactggagttcagtggcacaatcccgactcactgcaacctctgcctcctgagttcaagccatcctcccacctcagcctcctgagcaactggaattacaggcgtgcaccaccactcccagctaatttttgtatttttagtagagacggggttttaccatgttggacaggctggtctcaaactcctgacctcaagggatacaccagccttggcctcccaaagtgctgggattacaggagtgagccaccacacctggccaaagtatcttaattttatttttaagaaaaatccaggaatagcaggagttcaggtttctgcttaagctgtgttgtcttctgtggttcagatatatctgtgtctgtctgtcccactgtgtgggtgactccttcagggttttccttgtatgaggggtcagttttcatcatagtcttggggaagggggaccttagttcaaagaggagaacttctactctcaaggagataaaatttggaaaaaataacttcagcagttagtgattttgcagtttcagtaatcaatacataaattattaaaaagtataaacttgccaacgtttgaattgatgatttaaaagataaagttgatgaaatgtgtcataaaagaaagtagaaacacatagttatagattcaaaaggaaagataagagttttgaagacagtgccaggagattagactcattgaattaacaggaagaaaaaaggaaagatgaaggaaaagtaatatttcaaaaagaactataagacaatgtttttgagcagcagaaagataaatatacagttttgggtttcttgctaggtatcaaaaaattactgggaaaaaatgtgaacttttgaaattccaaaatcctaagttacatacaaatgcttaaagcttccagttataaaaaactgttcacatatcagagttaacctgtttagcctcagatttgcctccaatacatggacgctattccgcaacatgtatagacttttgagaggaaaggcctgcaatgtcaaattctacacatgcataaaatattatacacctattgctgaaacaaccataaggtgagaatagtctcagtgaatacaatccatgtttattatttggaaaaatatctgtgaactctaaataaatttcagtgcaataagactagaaacctcaatatattggaagatataaaaggggaaataacaacaatgaataaaagatggataaaacaatagatggacacaatttctatgcttatatacatatcatatataattgaatgatgataatgttactgtgaacttataagcacacagtgagtctttttggaagaggaaacgtgtagcaagagaaatcctttcaatagactgccccccacaaagaaaacaaaaactaacaaaaaaacccctactttttcaacaaaattaagtggcagatgtgggagaagggggggaataataaagaacaaaaaaattaacatataataatatgccaccacaatgacatacgtgagatccaaataattaaattgttaaatataggttcatgtgttattaatttattaaaacatataatacattatttttaggagatctgtacggtctaaaatcacaaaagatagtgtaaagtatacaaaagtacacaactgaaagatacttgaactgaaaagtcccaaaggatcacaaggtggtcaaatcctaaccacagcccacttcttataaagaataagagctttaacctaaccctgtttgagaactggagctgggcagaggtgaggagccatttactaattgcattttctccaaattcaggtttgacaggggttactgcaacttctaagatctcatattgaggtaaaaagtgaaggtattctaaacatttatttcagtgggacgggggagtggatatgtaaagtgtcagtgggaaaaatacaggtttaattgtgacagttaagaagtggaagttactactagactaaaaatgcaatagagcttctaaattaccaggagattaccaacagtgaatgaagaaaaatttcattattgtttattattagacaaaaatctaatgatgcattggacaatattaacatcagaacaaagggaaatcaaggtcatcggaactaaacaagatagagaggaatattatgtaataataaaatttaacagtccataagagacttacaaatgatgtacatctttacatagccaataacactgcagaaaaatgtaagaattgagttagacgtcgaaagctatggtaacttgttaaaataaaatttcattggaaaatttcagtgcaactatttcagaatataaaatcaatgaggacacaaatagaatatttaaataatataatcaataaacacaatttaatagatttgtatgcaatgtactatcttaaaatatgaatatacatccttttaatgtccttggaacactataaaacaacactaatacacttagatacaaaaaattttaatatctatccaaagagatattttataggcctcacttttgatcatagctttctctcccccaagattaaaatcaataacaaataaagtctatgcctgaaaaacataactagctcatttctatttaaaaatgtttttctaacaatacgtgattaaagaggtgaaaatataagtcacaaattatatttaaaggatgaatgggaaaaataaaccctcataaaaaaaaccaatgggtcacagtcaaagctatctattttcacaggaaaaaaataaatttccagaagaaatattttcagggttaattaatatattttctgaggaaaatatgtagcctgaaccgcatttaaaaaattattgttaaaagaggaagccttaaaatagattaaaaaaaaaacaacccttgatttcaagtatacaaggtgtaagaaacaatgaacagtttacaaaaagagttacctaaagtcaaagtaaaatgttaggaaatgatttgtgatggggaaaaatggatgaagtggtcaggaaagccctttctaaagaactaacattcacagaaaattaaaggaactgagaacataagtcaagtgaaaatctagctatttatgggacttctctttgtggtacctgggattacttatttttggttcatattgaggtagccaagaaggcttaggtaggtaactagaagaaacaaaatcatttcctttcttcattgttttataacagtgaacctatctttacagcttcttatgattatgtagttagtatatttgtattataaaaatcaagaggaaatattaaaaaataaatgtaattgtcccttgaaattctgctgtatgaagaaaaccaaaatcaatgttacagatcatctgttcatgcacctcttcatgtatgtgtatatatgtatatacaaatattattttgtttcttatggtacatattttaatgccatgttttatttttttcaatgtttgatatttatcttctgctttccctcttctgcctcagataactaagattggccacatactgctactctttcatatcttattcaatgcccaaatgatcaagtcactgtgactgtagctttaactgttgacacagatttagatgataacatggatatagacagcaaaattgtcatcattattttgttttaaaaaatgatcacaatcatagtgcttctttacatcttgtttttctcctttcctcatagactgtggcaatctttccaagtaatttggtctgaaccaaatgtagtctgttagtagtaaataataatccctgatatgaatggaccataatctatccaatctgtatatttctgaatagtattcacttttccattctagtttttgttactgtcaaaaatcctgcaataaatatttccatgtatgtatttttatattttgctatttttatttatataaatttggctctgaggagtgagatcaatgagttgaagaatatgtatatttttaacttttaatgatcctttcaaattgctttccaaaaaaggttcattactaactcacatggacagcaacaatgtctgagctccatgctatctacatccttatcagcaaccatttttttctcatctgataagtatgaaagactaccttgacattatttttatttgcatttttccaacaaaaaggttgcatgcctattcttttgcttccgttggtcttttatgtttgtaattgtaggagctctctaatcatacatttttcccattttttcctggtggtgtgtatgtgtttttcttgtcaatttgttatcaataatattattgataatagtattgtaatgtaaaaatgttattattaataacaatatattattgataatagttatcaataatattattttaaatatattgtgacctttaatctagtatgtgtagcatgtatcctgtgtttcagtattgattttaaaaatatttaaataaacaaaagtttaattttcatatattcaagtatctctgctttttccattacacttttgggtttattgttttggttataaagatttcaccaccctttggctttaacatttctcctgacatgttacatagttataatttttaaaaatatttatgtttttattacagttatggtatttttaaatatgacatgaagtagatatctaactatctctgtttttgatagaaaaccagttgtgctggcatcacttattaaatttccactaaattgaaataccatttatttaatttatttagttgtcatatatattttagaatcagattctgggcactgtattctgtttctctggtctgttttattttttatgctaatacaaactgttttcattacagagacattatcatatcttttattatttggccaagcaagctcttccaattcttcagaacctgaagctgaacataagtgttgccctcattctaattttacatattttgcttttccagtgggattgtatggtacccaacctttctgtaagatcatttttgcttaaaaacctcaagtggtttatgcattcctagctgaactctgagggatgcagagtatatcaaggcagctaaatattttattaatatatacatctagctgggcagagatatttagaataattaattttcaagaatatcatttttaatagcaacaaggaatataaaatgtctaagaataaatttaacaaaacatgttgaagacatttatggcagattttcataaaaatacataataaaaacatttgatatattaaaattgaaattgactgcataattaacagcatgaaaataaatgacaagccacagactggacaaggaacttggccaatcgaataacctacaatgttttagtacctaaaatatataaagcattcttgcaaatccaaaattaaaaatgcaaataaactagtagaaaagtggcaaaagccaataaggacataaaaagatcataaatttcgcaatgaataaaggatgtgcaaattaaaaccacagtgaggtatctttttatccatcatatttgaatattttattttttaattcacagtatcatgttagtgagcaaatgcaactaaaggggctttaagggtctatttattgataacagtaatagagatatgcaccatgaaattatagaaatcctaaatttgtattcatctaataatatgacctcaaaatatatgggcaaaagttgacattactaaatggagatatgggcaaattgataatcatagttgtaaattttaatacacttttctcagtaactaatgattcaagcagacaaaaataacactaaggacatagaaagttgaacaccagatgaaccaacctgaactaacagtcatttgtagaacactacctgtagcaactacaaaaaggcattcttatcaactgcacatataatatttaacaaaacagaccatattcttgcctataaagtaagtcttaacaaatttcaaaggactaaaatcatagagcatatcctctgtcaacagtggaataaagttagagaccaataacagaaaggtcactagaaaatctccgaatattttgaaactaagcaacacatctctagatagtccttgggccaagaaataaattacaattaaaattataaaatattttaaagtaaactccaaaataatatatcaaaaccataggatacattcataacagtcctcatagagaaaattattcttcaaaatgcatatattaaaaaagaaaaaaaggttaacaataaaaaatctcagttttaccatagagtatttagggaaaatacatagcaaattaaacccacagaaagtaaaaaactaaaagaagatataaatgaaagagtaaatgatatggtttggttgtgtccccacccaaatctcatcttgaactgaagttctcataattcccatgtatcgtgggagggacatgatgggaggtaatttaatcataaaggcagttaccctcatgcttttcttatgatagtgagtgagtcctcacaagatctgatggttttataagggcctttccccccttttgctcagaacttctccttgctgccgccatgtgaaggagaacgtgtttgcttccccttccaccgtgattgtaagtttcctgaggcctccccagctatgcctaactgtgagtcaattaaacctcttttcttaataaattacccagtcttgggtatgtctttattagcagcatgaaaacagactaatacagtaagcaaatgaacaagataaaaaatgagaaaagctttttgttacagtgtgaagaaacaaaatatcaacatcaagattcctacagatccagtcatcagaagaatcataacacgatattagaaaccagcatatgccaataaatttgcaagtttaaaagaaatgaaaaaaaattttgaaaaaaaggaactatcaataatgacacaggacaaaaaattagcaaattgacataaccctatatccattaaaataagctgaatctataatttaaaacttttccttaaaaaatctccatgtccagatgacttcactaggcattttttttcaaaactgttcaaagaagaaataatattaacacacaacatatacaacatgcaacaacaacagagaacagaaaaacaatattaccaagccactcaatttagaaaataacaataacattgataccaaaacttgtaaagaatattacaaaaataaaagaaataaggatcaacattgttcatgaatatagatgtaaaaatctaaacaagatgatagcatatgaatttaatgccaaacgagaaaaagaaggatactaactcacctttttagatataattagcttatttaaaaagagggagatggagattatttatgatagaagagttcagaacttcagtgaaatgggcatcttcatgttgataccacttcagtagtgatttatttctgtctacattccttccaagaatgtcaccatctctaaataagaataatccttgtcatctataactactttgttgcctccatattctgggagacaaattttatctccaaatttcagactaattggttgtatctctccacgctttcctttacagccagacgtaactaccactactgttgcttgcaatacttatccttgagattttttgggaagcataatacctcctttggttacagttttgactgcgatactttcaaccaatactcagtcagaaagcaaaaaaattaaaaaaaaaagttctaaatgtttgtcctgccatgactcctgttgttcttgtgctgctgttgcatggaaagcctaattcaatttgctgagaggtaccttggaaaaaagtctacggttagtggtaaaatattaatggtttacttctgagataataaacaaaataagaatatccatcatcatcacttcaactcaacattgcatgttctagccagtggaatgaagcaagtaaaataaataaatctgggaacgttgggaaaaaaatcatgattattcatagaaaacatgtctgtatatatagaaaaatgaaagactcaaaaaattaatggaagtaaggagtgaatttagcaagttcactggatatagggtccatatacaaaataaattttgttttcataagctagaacatgcaagtagaatattaaattttaaaagtattatttcaatagcaccaaattcagacatattgctgtctaaatctaacaaaagacatatgcaagatctctactttgaaaactatacaacattgttcaatgaacctagaaaagacctatgctcttaaattgaagggcttaatattgttaagatgtcaattctcttcaaattggtctatatgctcaatgcgctcaataaaaagtccagtttttttggaaattgacaaagtgattttagtgcatctatgtctgtgtgtgtgtgtacacacacacactggactaaggcaatcttaaataagaaaaataaagttggatgaccatatatcaagatttaacataaagtttcagaaatgaatatactctgctcttagcaaaggataaacgtattagtccactctcacactgctatgaagaaatatccaagactgggtaatttataaagaaaagatgtttaattgactcagttccacctggctggggaggactcaggaaacttacaatcatggcagaagtcacctcttcacagggcagcaggagagcagaatgagtgcaagcaggcaaaatgccagacacttataaaaccatcagatctcgtgagaatttactatcacaagaacagcatgggggaatccacccccatgatccaatcacttcccaccctggtccctcccatgacacgtggggactatgggaactacaattcaagatgagatttgggtggggacatagccaaaacatatcaataaatacatagaaaaataaatagaagatccagacccccccaaccaatacctcgcagaatccacacatttatggtctccccagcaatgaaaaaacaaagtatcattttagtggggaaagtacaatcattttaataaatatgcaggatctatgctatatctctttggaacaatgagaattgacccttacctcccacatttaatttgagatgaatcatagaatccaatgttcagggaaaaacaatgcagattctacaagaaaataccttcagaaatgtagagtaggccagagtttttcaatctcatcactattgatacctgagaccagataattgtttgttatgggagttatcctatgcactgtgggatgtttagcagcaaccctctattgactagatgccaccagcatccagtagctaaaattaaaaaggctgacaataatacatttcaaggatgtagaacaactgggtttcataattactctttgggagcaatgaaaaactcttgagaagtacctgttaaagctacatattacttgtaatttatgctctatgaacaaccaatttctctttcaaatatatacacatacacatatatatatttgtgtcttacatatatatatttgtgtcttacatatataacatatatgtatatattatatacatatctatacacacagagagagaggtaaatctgtgttcatatccaacaatggcatctttatagaagcattatttataatagccccaaactggaaacaacccaaagtggagaatatacattaacaatggaatattacacagcaatgaaaataaattatggctatatgcaaagcaaaatacatcttacagacttaaggttgagtgaaaaaaggcaaatatgaatgatgaccgttgcatgaagttgaaaaacagtcaaaacttatctgtggtgatagaggccataataggttaactaatgaagagaacataagacattctgcaagggtactggaatgttctaaatcttgatctagataataacttcatctatatctatacaaatacagatatagatatgaatattaaacttcacttttggatagagtttatctcagaaatctggagaatgtaggtaaagaaagtggaatatgatcaagaagacacatcaactgagattgcattaaagatatatggaaatttggtgagatttgctctgttttaaatactaaccctttctttctaataatgttacatctttccatttctttaactggtatgcccttcattaagattttatggttttattagtgagtcaagtaccttcatttttcaatttattcctaattagtaaggaattttgttgcttgtgtgagtagggcattctcccccattcccatttatagctgtttttttgcaattagatacttaaggaagctgtggatgtttctttatatatgtacacagaatgtacaaaacatgcattaccattgtaccttgttagttctagaagtgcgtgtttgtttatttggttatttattagagcttcttggtttatattggtatataagcataaaaatcaattgtctataaaaataactgactttctattatttttcagttagccagggtgtaaagaaagtagcaattgttgctcaaagtattctcgagcccaacatgattcatcacttaattctgaaatgtcactgtaatctcatttcaatatgaggaaatccgtacagtgtctcagaggcgcctgttctccatcacaaggagacgactcacaagagatcaggaatgcattttctctaattgattttccttctagatgtgcatgccagttctgtcactttctagttctgaccatgaacaagttatttggcctccttaaggcttagttttcacatctttaaaatggagaaataagttttacttgaatggctctttcaaaggtcaaataaaatatttaatgaaaataaaaagcttaatggagtgactgacacatagaaaggactcagtaattattagctagtaatagttatatcttatacatggtgtttatacctaagacagtgcaaaagcttcatgtttcagaatcagctacaaatccaaattgtacctttctcctgagaccgtaagttattctgtcttgttacccattgctgtcacagagcgtggttcctagaaacaactggaagccatctgcagtgagtttgggcaacctcatggttgtgttgagtgatctgatcccacagctcaggcatctgacagctgcagtattcgtgcctcacttttctgcctgactcttgctcttggtgaaagcagttactgcaccaccactctctggactttttccgctgcatcgtccttttgtcttttcaatatggaactgagattctgtgaacaacagggccattttacagcctataggctgcactctgcttgggggactgagcattctgaggcaggttcctgccctcatcccgttctggtcccatatcatgattgttccagtgaagaaggtgttgggaggtgccccataaaccttccatatttagggtcttctgagctggcagcccactgaagacaaacatggccatgtgtcgatggttgtggaaagaggatgcatattgtccaattgactgccaccagcatggagcatggcatgctggcagaagcacaagatccagaagaggatagaaggatcccaggtctgggggaaactaaactgtttcatcctttgctaagggctggggcccatcaggatgctctgggctgtgaagtcagggcaggagaacaagactgtggaggaaaatgtagtcagaaaagacagtctcagcccacttctcatctgtttcattcaagcctgaatcatgcctcatctctcctcatgctcagcagataacgttggatcaactgtatgttcatttaagtctcctcagcgttcttccttctgatccacccatatttttaccatcatctcctaccaacctacaggcagcctccctgactaacatggatctctgttctgttctgtgcaatttttattaatccatctttgttcttcacatctttgtactacccttttcttccagtatggtcagtgtcttcaccatctctgccatcgaagtttaattcctatctctccctggggatcccctctccagggactgctatcccagtctgcctctcaaaattaaattctaaagaccccacaaaatttttgaggatttttccaattgtcctaaaaggttataatcttaccttacagggaatttccacagaaccactcacattacattcacatttgtaatacatttatctgcattactagactggaacttcctgaggtcagacactggggcttaattatttttgcatctctagtactgcaaagggtaggttgaacacatattggtatttgaataacaaagaggaacatttatatgacgatggtatatggaaggaggacatgaagagccgctcagcaccactagtttattaggaaaatgcaaattaaaaccacaatgagatacccactaaaatagctgaaatgaaaaaactctgacactagtgctagcacttttgcagagcacctgggactcttgtgaattgctggcagaaatgcaaaatcacacagccattttgtcaaacagtatgacagtttcttaagaagttaacatacacttactgtatgacccagcaatttgtctcctagatatttacctaagagaaatgaaaacttacgtttatcaaaaactaactaaacaaaaaatctcccattcctgttacagtggcttcatccataattttcaaaaattagaaacaaccccgacatctttcaactgcagaactgataaacaagctgtaccaagtccatgcaatggaatactattcagcaataaagaaaacgaactactaacatgaataacagctggatgaatctcaaatgcttgaggctgagtgaaagaagtacactcaaatagtttcatatcacataattctatttagatgacattctgcaaaaggcaaaaatgataggaaggaaaacagatcagaggcttccaggggttgaagaaggggtacattttgggggtttgatattaatgttttgtatcttgatatcaatgacggtaaaatgtttctatattttctaaaattcataaaactgcatacctaaaatgattttgtctgtatgtaataatatactttatatccaataaaatataatggaaagaaagtggaaatagtgaaacctctttcttatcatcaatgggccctagagaatcagcaacctatccctagctggctcccacaaactcactactttacccccagaagtcactgagatggtgaggctaggatgtgactatcacaatctgttcctgggtccaaagttgaaggtagtaatgacttaaagtgtttgataaatggggagaaaataaaagtgagtagtccagagttatcaaataatttatgtccagaacatgaactcaaacatttgactgacataaattttattgagttttctttacattaatccaactcagtaggccaatggatagaattcaataaaaataatgtctgtcaaaaggctgacattatttaattttaaaacagagttaatcagtctttactttgggctctcctagcccccgtgtataccccttgattgcagtatttattaaaatgtattttaattatgtttatatcccagtcttccccaccaggactttgggttccttagggtcagggattttaagttactgatatttgcactccaggtgcatcacaaagcaagtgctcaatacattttttgttgttgttgaaaaaatgaaaggatgaatgagggctcatggtttccactactacatatgtgacatgcccatctccccattctatcttctgcttctccataatttgcccactgccacacatctctaaattctgcagaccacccccaagctgtccttcctgtctcatagctgcagcaaaagccctcttaacgcccactctggttcctgctcctcttacaattctgtacccagacatagacatctcactgaaacattaaacagatcataccgtgctcaggcttaaatctgccagtggtttccaattaggcatagaacaaaaatcagattccttagttaagctttggaagccctacagttcctgaccctttctatctctgtgaccttgtgtctcactatctgtcttggccaatatgctgcttaccactgaatttccttcagggtctcacacatgcttggttgagtcagcctcatagcttttgtgtgagcagctccctgacctagaatgtattttgttctgctcttcatattgctggtttcttctcagcatgagatcatggccacaacatccacttttccaagaggcctttcctgacacaatctaacctcactctctaacacactacctcatttaacttctctgtataactctcattccaatgggatatatatgttattcattgtgtatttgacaataattctgtcttcccttttggataatatgctctaagacagcaggaactctgtcttaactctggtctcctcatcaccaacacagagtaaatgtttaatgaacacttgttaagagatgaacagatggatgggtagatggatgaatggacagatggatagatggttggatggatggatggatggatggatggattaatggatggatggatggatagatggatggagggatggagggatggagggatggatggatgaatgtaatggacaggtggaaaggaatgaatggcatctttcacggaaggataggaacagctattattttctaacaaacagaaaacccaaatgaccttatccatagacatttcttctactctgtgttacactgaaatgtgttgcagaccacctcactgatgcctgtctttatctgatgtgcattatttacattaatagaagaggaagcagggaatcagacactgacttcagcagggtggataaggaaattggaaaaaaatagtagggaaaaagaaatgtggggatgttacatactttataattattacagctattccagatctgtacaactccccattccctcttagatggcaattggaggcacctgattttcttctatcctcctaaggtgaatgctcactcttttcccctcagcctgttcaggccacagcatctatgtagcttgtagacaaggagatactgacttttacctcattaactctgtctgggaagcccaaagtcatggttagacctggcacaaaacaatagccgaaaaatcagggtcatctcctttccaaatggcaatctgctttactgaggccaccagaatgtaatatagtctctttgcctctgccctgtacaaagatatgaatctgggtattttgttataacttgaaaatcaaggcagacgattaaaaaaattactctcagcaattcagttgaataaaggctttaatatctaaaatgaactacaggtgtaccctggcaattttaacactgagatttctccaaaaccaaagtcagatggagcaggtgaccaggtgccagagtttttcagacagcaatttctggagccagattccctgagatcaaaccttaccaactaaaattgggcaagtcacttactattttcatttctcagttttcttattatgcagtttgtgctggtgtggtaagaatttcatgagcaaatgcatgcaaagcactttgcacagtgactgccacatagtaggtactgagtacctggtgtatctactcaaagtcattataattaagtgagtgaatagcttcagattttctttactctactctgaaataacaccagtcctaagtcactctttgaagcatcaattgctgaagattataatagttgatttccttcagtgataattccacattgcttttgtgctgttctttttccagagccttgggatggcaaggtatgggtaagatgggaacattttgccacatccattggcagctggagtgaaattccagcaggcactccaaatccatagctggtaagaatccagctgcagagcgctgcaggaagtaaacaagttccatccactccaacttccctctgttctacatctggggattcacagccacccccagacttcagaacaccctcatcctacacagtgggtcaactgacagaaaaaaacactgctatgaaggataatgtgtttgctgcagacaaaaatgattgaggccaaggaaacaactttttcatggtagctccagaaatttaattttaaagagcccttgagagaagccagtgtcttcctcaagagaaaagatggcaaattgtatcattttgattcacacccatgaatgatgtttctgcagctgtttgaattaagactgaaatacaagcaatctcagtaggagtctgtattttcataaaacaatttcctgctgagttagttcagccagctctaccccagacctttcacacacctcggtgatgaggacatttacaagatagggttatttttgcttattaaagagctcacggagttttgtaatatccaactcttctcaaggcgaaggaacatctctggatctccccacacacatatctgaaataaaatagagttctaacctgtcctagttgccactggaaaactctgtaggaactgcacaccaaagaacacagtcctagccccaccagaatgagatttctcatctaactcctgctttctttctttttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggcctaactcctgctttctaaacctcttgagttgaagctcctcaactcaaaacctggctgtccccaaccccggagtcaatcccaggtgaatgcttggtccacctgtacccactgagctgtcacatttccctacattcccagtagatgggcagcaaatgcatgaggcttttcctaaagcaactgttatgccctcaagggtcctcaatttcagacccctttgctcagttcctgacttcctgacacagtcttatgacttctttactggaaccagaatgctgtgtcctgacattttgcttttactggagaggaagtagaattctttattcttctacactcctctatgtagtgggagcacgctgggagggctgtgagaatgagggaggtgcatgttatatcttctccttcacatatactctcacattctgtattagtcagaaatatccttagaggttataacaggaaacctaatttacagccattcaacaagaaaaattccatctatttggagtttttttacagcatgtaacagcaatggaggtaagttgttgctggatttgattgagcagctccaacatggaaagactgagactgttctgattcttttggccttttcctcatggttgcaagacggctgctgaagcttcagccattatgtctgagaccaaagtaagacagaaaggaaaaagtgtttttcagaccttttgtccccataccagaaaagcaaacacttagatctaatctatcaacaaataacatcaatttacctcttcttggccagaattgggtcacatggccacccttagctagaaagaaagatgtaaaagggtgaaaataattgttgtgatggtcttagagcagggcttctcaacctcagcattatcatttggggatgaataattctttgttgtggagagctggcctgcgcacggtaggttatttaggaatgctcctggactctacctaccagatgctcacagctattttctcctccaggtgtaacaaccaaaaacgtctccaggcattgccaaatatccactggggaatgaaatcgtctgtggttgagaacgactagcttaggccaatcatgactcattgtctggtttaagatgcatggctaccctgaagaaaagtagggtatcaagaaggaagaataagaaaatatgtgcaaggtaaataatcgtgtcatgcctcagacacacagcctagacatgcatgtcatacctacacagtacacacccgcattcatgagcacttgtttggcgcttggagtcatggcataagcaaatgttcactggtgtggagaaagctcttttctcttcagactcctttccctatgtatttacatgtaaaatgtaattgctttggttaaatgcaattaaattcaaatcaattaaatcctttacatatttactgccataaaccaaaagtttagcttgagttaagcctgaatgtccagaaagcggagccaaagaaggaaatgtctccaaatcaagagatgcaggagctggagtgaaggataatgaagaatcaaacaaaacctcagaaaactaaggtatgtaagaaccagaaaaaagctaaatagtaaacacctatggtgtgctatgatgaacacttatgaaaatggaaaagaagttgttaacagcaaaaccagactcctctaggcaaggacaacttatttagtgtggcccaaagcaacctacaccatactgatcttcatgagtaacaagggaaaacttttatgttctgccccaaataacatctagggctaagcattcaacatcacccctgactgtaggtactaagtggcataggaagaaagaggctatcgctattatggggtcagagaagaacgaacttccttagagctcatcattaacttaggtctgtacagtagtaaataggaacataaattgctataggtaggaaaacactttgtacccctaattctgggagataagccttttcagacacagagactgagaattctttgaagtaagactgaaatctgatatcagaatgttattgtccccatggatgagatacattaagaagcagaggatcaaaagattattcacaacaaggaaataagaaaagtaaatttggtcagattagaggagaaatgtttatactcgccattcctagccaagactttctccaatccctggtgataaacttgggggtaaacaccttaacggcattataattacgtgtgtgtgtgtgtgtgtgtgtgtgtgtgtgtgtgtaattacttcaagtttgttggtataagcagtgcatttgtgtgtatatgtgtatttaactatcaaagcatttatcacattctgttttgatgtttaagttacccacctgtctcccctgctagactgcaacctctgtaagggtagggctgatgaacactatgtgtgttaaataattaaatcccttttaaattcgtgtatgtatcaaaaacatatttaatacatacttactaggcaccaaataccatgatgggtgctggggacacaatgctgaaagagggaaaacacacttagacacacacacaaacaaaatagacaatgatctttgtcttcacagagagattttagtcaatgtcaggcaacataacatttcaattgtgaaagtctatgacttggtaattggtaatttgacctaaatgagaagtgaaaactccagatgatgaagagaggtgagcctcctgtgtgctaactgggggtgagggtgagataatcagtcatccagtaacagtctatgaggcagtgaggcaaagaaaggtggaaggatggagagaggcagtgttgagcctggaatggacctttccacagggattcttcccactggtaaagtatatcccagtgaatcttaagctataaccaatcataaggtgtagaaaaaaaaaggcaccatgtgtcattccctacattcccttctgtgaggaggcacagttttatgtgaaaccaacatttacaaagactccaaggaagacagtatagacttacagcatctgagcacttaaattggacagtgcagtgcagccactatctcctgcacacatgttagggtgaggtctttgttgtacgaaacaacagagataataaaatggaagagcagaagtggccattctaattcaaagatggcagtaacatgtagtattgaaaataatagattctaggccaggagcagtggcccatgcctgtagtcctagctacttgggaggccaaaatgggaggatcacttgagttcaggactttgagaccagcacagccagtttagtgaaatccagtttctccaaaaagtaaataaaaaattagctgggtgtggtggtgagtctgtagtcctaactacttgagaggctgaggtgggagggtcacttaagcccaagaattttgaggttacagtgagctgtgaatgcaccactgcactccagcccaggtgagaaaatgagaccctgccccaataaaaagaaaaaaagggaaaagaacaaattctgcaggcagactacctggactcaaaccctggttctcccctctactatgtgtataacagtaggcaaattacttaaacttactgagcctcagttttctcatctgtgaaatggcctaacaacagtacctactccatagggttgttgtaattactagatgagtcaatagaagaacttaaaggagtgactggcactcgggaaatggtataaatgtctgttgaataaactaatatcagttttaggtccatgtgcatgcacatgtgtgtgtacatgtgtgtaaggacctgtgtgcatgcacatgcatatacatgtgtgtatggacctgtgtgcctgcatgcataagtgtatgtacatgtgtgtatgaacctgtgtgcgtgcatgtgtgtatggacatgtgtgcgtgcatgtgtgtgtggacatgtgtgtatggacttctgtgtatgcatgcacatgtgtatgtacatgtgtgatgaacctatgtgcatgcacatgtgtgtacatatgtgtatggacatgtgtgtattcatgcacacatgcagttgggtgaggaggagcctcagttggtctgaaggggttccagcatattctactcttgggaatatttcctgctgggtttcaggaggaaatattcaagttctgtacactaaattgaggactggctcacctaaagcaagcaaaaactaaagagaggtggatgctaaaagagcttcctccctaagatacagagcagttttcactcgcagccttgacctcggtggttttgtcacctaaaaccattctagtttcaagactcaagctacaatgcttttgagaaatgatctaataaaagaattaatagaactgtggcagaagtgagccctccaaaactggtcctatagaagcttctgtcttagatgttttctggggccagacaccggatgccctctttctccaggcatctcaaaaatagccatggtatggacaaccagcaacatgatgtcatacccataacaaaactggaattctttggatacatagctggagttttctccttctgccctacaaatgaaggctaggggtcttagaagcctccagaacaccattatttttcttctccattagactaagaagcaggcatcattcatttattataatggtgttcttcccacattgttactggcacattctgtgctttacaacaacaagaaatgaaacgtcccctgagaagcctcaggttacatttatttggctttcctttaataaaaaaaaaaaaggagtaaagccaggaatgaaagggagctgagagctgatgtactttcctgactgagttcaaggaggcagtctgtggtgaggccagagatgaacagggctggccactagcaggaaaacataagtgacggcttctcccagtaaccatatgaaaatgggctgatctgttctgggactcaaagcctgtctccctcatttcacagaaaattcaggagttttccaatactcagagaaccttcagaactgtgtgggtttgatacgttttcctaacctgtttgagtgcacagttttggggaactttcaaaggccagggtatgactttggaataaaatctggtttaatttcaggagaacacatttaattctgatgatatctaggcctcaggaaatgaaggcagaatgagatctcccagatttgactggttgttcatgccagtttgtatcagtaaaagctagctcctcaaagcaaaccagaactcagattcctcggggtgggaaagtgcagacagtggactgttgtacccaggaagcatgcctgaggtgctgacagaaaagaagtttcaatacgtgaatcttcagcccttcaacatagttcactataatataggatgattccagaggtgagaggagtgagggtgatgacggcaataattatgcaaaaattcaaaacagaagagacttgtgtaccctgatgtctcacctgtccactcttcttgacagaatccctcatacctggcagcaccaggactgagctttgtaaactgaagactggctgggttatagtcaaatggtaaggcagaagcaaaataccccaattctgaaaggagaagacttcaacagccagtgatggagaatttaatcttgggtcaaagccacatgagggctgcaggaagacaagccgtgtaaacaagagggtctactttttgaaattgctaaatacagattctgtgcctgaatgcctctgatagtagatctcaaaaagagggcattctgaattcttgttagaacctctcactgacctagtccacagactgaagctggaatctagagaacaaagagaagattagtggatagcttagcttttgctgcataagagaccacccccaaacctctgtaactgtaagcgtttatatacctctcttgatttttctgagattcatgattccttgcctggaagattctgattgggcatggcttggctgaggctgggtggtctagaatggccttactcacacatctgatgattgacgcaaagagctgtggctactggaatgatttaactatgtatctttcatcacccaataggctggcttggcctcatttacatggtgctggtcacaaagttctcaagagtgtccagagaaggccagctcaatgtgtgcattcattttctgagcatcagcgtggctctcattgaccaaagcaagtcacataggcagtccagagacagtgtgggatggcactaccaaaggtcatggatagagagaagaaaataacacatggccacttttacaataagccacaagttttctcccttccacccattctgtttgctcctgatagaatctcctcctctgtccactcacagtgactggcctgaaatacagttactaaaaggaaatctccccaacatacatagtgaatactcagttttggtgtcaatagttaacaagattctctcgtttgtcaagggttggattaaattaggatggtcagcatgttcctaacactcactgtttaaacagaaagggcacactcccattcgagttaagtcacaggctcaacagtaagtgtattttccatggggtaattgctaaagccactgcttttccaagaagaatccttttggagtcttttgttcttttgattgaaacttaatcagcttcttgtttgacaaaaatgacaggctgcatgaaaggggaaacagagtttgggttttgccaatcctaattcctatcaaacatcacaagaaaataagcactttctacataatgttctccactttgtgttttagactcaaatttatcacttaaaaagaaaagaaaaaaaaacaccctaactgtttatattttgggggaaaaaaagaaaagcgatggttaactccttctttctggggtttttcatgttaaggattttttaaggatcaagactcttgactttacctttcagtttggtggggtagagatatagggaagcaaaagttcgccagatcacttccagatgatacgtcctgaaatctgtcttccttctgtcacagaggacctaccctgcagtcaaagtttattgtctcccaagtctcatccagacttccaattctgaccccaagccctcatgctgaatttcataaagagaacacacatttctaattctgttatgaggaaagcactagatttgcaattggaagcacattcatcttggccagagactcactagctgtgtgatcttggacagattaaattcattctctctgattctgtttctgcatccatattacttctctatttgaagggtggctgggaggtttaaattaaagaatgggcatcaatgtgcaaacctggggcccaaaacttagtaagggcttagcaaatgttaattttatcctatctgatttctttctttccatctctttccatattattctcattttcccattctaggaaaaaaaatgcaggctagcatattccctttgaatgaaaagagaaaaagccatgctgttaatctctgtgacagaaaatatggaagacactcaacagagagaggcagctttggccagttttatgcctttgccagtgcttagttgtggatagacatgtaactctgccccagccagagctagacatatgggggggaggcccatctttctacaatcccatgactagtaagtggcagagcctggatttgatccccaacagtccagtttcagaatccatgtgcttttctactaagctataattccttgctaatataaacccattcattcattcattcatttatgcactcattgtccaaaaatattggctgggtgttgtggctcacacctgtaatcccagcactttgggagactgagggggggggcagatcatgaggtcaggagatcgagaccttcctggctaacatggtgaaacgtggtctctactaaaaatacaacaagttagccaggcgtggtggtaggcgcctgtagtcccagctactcaggaggctgaggcaggagaatggcatgaacctgggaggtggagcttgcagtgagctgagattgcaccactgcactccagtctgggtgacagagcgagactccatacaaaaaaaaaaaaaaaaacaacaccaactctgtagagcctatgaatgccaatcactatggtgaatgttgaatctgagcaaagctgctagggaatcccacacaggaaggcagtgaattttgtctgagggagaaaggcacaagtggactcaagtctcagattcattatttacacgtgtgatgttctgcatgttagttgaactcagtgaattgcagtctctactgtttttgtatagggtggattcgtttgggtactgaagcaaagtgaaaacagctaacccaaagcctacaatgtggtagttacccgagaaatgttctttaagagaattcataaaaaaaaggaagaacactgtacagggatatttttaaaggatcttcagggagacagagctcaggtggagaagagaagcaaggagaggacatgggtaacaaataatagggccagaaataaccatcttggatgtaggagccagggacaaacaggcctgagaagcactgtctggcctttcagagccccgcagctgaatcctgaccctaacacatatgaaaatggggccttggccaagttgctaaactgagaacctcaatttccacatctacatcagagaggtgaggatgtccccctcccacaaggtgtggaggttacatgaggtcactcatgcaagtgccatgttgttgatgctgcgtggtgattgataattactcaataagtaattgtggctcacatgtttatgacagcaagaaggatgatgaatgttgcagggtggtggggggatggacaggtcacactttgtagggctttagggttgccatcagggtccagacaacatttattgtccagtccattgataatcctgattttctcctggcttcaactaagtattttggactctaagtcaagggtcaaaccaccagtgtctccacctccatgtgtgtctctgatttgacaggctctaatgccagggctgcccttaaaaataatcctttttgtcatacacacagaaaaccatgcttttccaggttgaaagtggatcccatctcacaaaagtccagctcagattgagaatttagagccataaatgctaaggaggtacaatgctcagaaaagtacattagtacttcttccgcagatgccccttagaaagtcttacatccagagtttggcttccaggtaaatcatttctgaatcaaggctggcctgacattttcaagcacagccagttgcacttgcctctacactccaccttccattctgacacttttcagtaatgctgttaattgcttatggatgtatctccccaaacagactgtgagttcttcaagggcagtgcctctatttaattcacctgtgaattttaatcctgtggagtcaactttctgtagataatgcctgaacaaaaaaattaagaaatataaacaatcagccccagagccttgctgttgggagaggttggactctctggggcagctttgccccaggatatagttccaggaggtgggttcccaggcggaagggagaaatacaaatgtacaagcagatgacagcccgtgagctggatatgtcccggaaataaaaactggacaagtcataaagtttcaggccaacaccaaaggaagaaatgctgggtctttacatagaactgtcctctaaccccctagtgactagcaattatttcctcctgccctgctggctcccctacaaagcaaggggcgtccagtgaggagttctgagcccagcataagcaaagcaccaaacacggagtgtgtgaccctaggagacgcagggaatctcctcctgcatctctgtctgtgactgtgttgtaagagatgaggacgggagaaacaacgggagaaaactgtgacaggagaatttgggattctagcagaaactaacaccagaatcttgggcaaaggacacagaattctaagagagaagtttgatcatgtaccaaatagtcagagacatatttgcttctatgagagatctcgttcccttaagtgaaatgccagaccctaaaatttctagttatccttaaaagagtggacacacaagaaaaggaaggagggagggagggaaggagggggtgaggaagggagggagggagagtgaggaaaggagggagggagggaggaaggaaggaaggaaggaaagaaggagaaagagaaaggaagaaaagggagaaagatgaaaagaaatgagtgagaaaagaaaggaagaaagaaaggtgaatttccatcaagtaagacccagagaaaagaaagaaatgacggcagctgaaccacttttctctttcctttttaatctgactttagatgttctcctggtaaaatcattacaaaggccgtttatttttaaaattgaaagattgggaagagtcataatgagatactatgtgtaaaagttgcacataaatttcctcttgtcatattttgggcttcactaacgcatccccttgacaggacgaagggaagttgatcgctttagtatagattgtgcgcgcctcagaaatattgccctaggagagagctcctgggtggctgacttggctccatgctgatttagaaattagccgggcttttattggccacactaaattgttctcaggaaaaaaaaatacatttttattacagaacaaggggcagatgattgaaacaagcctgccttctccttcatttggagctgtgttttagactgttaagttgactttcttctctggggttctcgctgctgtttaatgggggcatacaatatctaccattaaagaaattaccttgtttctctcagtgtccccagggaattccttattccttaataaagttctgtttgagttctcctgagtgcatgagtgggcaggttgaggaaaacggagactctctatataatattcctattgcaagggtttagaggaaggggagaccaggagccgtccttaaagaagggattcagagcgactgtgagtctggccactggccattgactccagatctaaggccagaggtaacactacagaaatgcacaccccaatcctgtattgagtgaagcccacggcagggccgtgcaatgaacttgcatgtgaggccaaacctgtcaaaagccacttggaccaaagggaatcattcatttgtagagaatgcccaaacccactcatatccaattctgttctcttgaagtccagcctgactcctgtctccgactctgctttgacaggcggccttaggctcttcctcagttctaaacagggcattgatagattcccatggaactgctcactactgccctccacaaaactgcctgcctgatttcagacagcctcttgcttagaatctgttctaggtacagaacccctagcccttctccaggagaaatattatgtccatatggatgggagcagctagaggatttctggaaactttctaaagattagtttcacttcttgaaagctaaaaggcaaacatataattgtatccaaagtaaattactagagtaacacagagcaactggggtatttgaggaaggaattgttcggccaactgaaccatttcattaacccttcaaatgtgatccttgattttattttcttaaatacttataaaatgtaagcaccttcctgcattaatatgcaatatgatggagcccttaagatcttggactcaaggtaagtcagaattgaataggacacgtttgctgtcattttccaaatataggtccttgggcaaatcacatccagtttttctgatgcggttttctcatctataaaatggggatcatcacagccctgctagtgagaactttatatatgttgagtttatatatgataattttatatatgttgaatttatttaatatgtgaaatatgttaaataagtatatttaatttaaatatatttaaattacttattaaacagtaagtaccacacctggtataacatacaaactcattaaacattagctgttgacattgctcaccatcagctcagcgctccttagctgaaaggtagatttatttcccccacaagctaaattctacaatagagccaagtctcacaaaacgttagtggttcagctgagacagaaaacataacttttgattacttatcctcctccactaaacttcagaccacactgcctcctattaaaattaatttctgttcccttcaggtggagatttaaatttgtcatgcctccctaagccactggacccatagccctatccctgatttttccttagggaagccaggactacttgaggtaattaatccaccacaggctcccctaccacaactgggaaagaaacaccaaattctacttggtttcttactaattaggaacagagagagggagagagggagagagactaaggacgggaaagggctgagctaagtggggtgtggtccacatgtgttcccaatcatgaccacacaatgaaaatgttttctttctggggcaatcaggcaaaatcttggaaagatgaacttttttccccgcttctttatgtacaataataacaatatcccaaattcaaaactttttttttaatcttggcacaattttgcttctaaaacatttggaaaacatccaagcactgatggcctatgcctgacccttttctctgaggtccaagccacttattctataataataataagcgaacacatagatgatgcattctatgtgccagactctgttctaagtgctttacaatacattgactaaaattcaatctccttcaaaaaccctacaacttaacactatgttcatccccattgaacagatgaggaaactgaagcaaaatagatttagcaacttctccaaagttaatcagctagtacagggcagaggcaggatttgcactcaggctgtctgaactctagatttatgctcatcattatcagctcatacttctatcatgtacctccatggcagaagggctaggggaaaagcagagggctggggctgcccaagagttgaagatcaggaggcacaaaaactaagaagagaactcccaagaaagttggagtactaataggcaatggggtaccagtccctcttttgagttgtggctctgcctttctggttctacatttactcagttcatgaaccaaacacctgtcaccattgcccttgttcactctgctctccccatgctcttcactttgattgacatgcaaactttattctcttacactcctgaccttgaattccatttctagcctgagtgtcccctaggccctgaccttcacacctccagacccagccaagtacccggattctggctcctaattgctccctttgcttaactgtctagttgaaagttcagaccctgaatcagcccttggctctgattaattgcagcctggggctcagcagcaggggtctgaatcccttcccagtcactggagtagccagacttgacctctgttggtggagcaatggaggatgccatgcctacttgttgaataagaaggctgctgtgaaacatactacatgagttggtgcatatgtcacagatgcaactctgccaacaggaagaccctcaggggctgactgccatctgctgaaaggcaagcagggatggatggatagatagatggatggtatctgacctctgattccttccagggttagatttttggagagtgatgttcaggagcctggggaaaccatcattccaggaacagctggccgaactggcaccatggagcaattgatggccttcaagtgcagagattaagtttaggccaggaaaagaggcacaggtctgggatacagggcagtgattcaaagataatggatatgagctaactgaggagaaggaaaagaactgtacaatatgtgagggatattgatggtggaggattccattgtgcggttcccaataaatgcacacagttcaactctaaggcctgatctttcccgtaagactggagagtactgggagatacactaatctctcagaatagcagaaaacaggtgccttgcttcctggattatccaggaacaaactcaggggcaaactcatcagaaatgacataaagaaagcacagagaattaggagctatgcaacttatatatgctaatgtatgctgactgcctactatatgttttgagctgctttttgatgtattcattagcttcctagatggggttctaataaatcacatacatattatacattgatctatagtctatatcacattaaaaatcagctcacttaattaaagcagcaattgtgtgaggttataatcatattattttcattatctcattttaaaaatgaagatattgaagcacagatagtcaagtgacgtgcctgaggtcacaccactgctctgggctagagtactattcacactgctgtcttggtggctgtgacagtgactgacctcctgccttccaggtgtcccatatcctgttgctgagccccaagagtccaatggaaggggtagcctatatgcaagcagtcctgcccacatgggagagtgatgagcaactggcttatcgaggtcaaccatgtgctctctcctggaaattcagaatggagccatgaagtgagcaaataatgatggaatataatgtacagtttggtaaagagtgctaagagttgacaaccaggtcagacacagctgtatatactcaaaattcctggggaagaagaagctatgagcctgctcagaagagtgaaaggatgagcattttcccagggtagaagagaggccaaagacatcttgtggcattcagtaggtggaagtggtagcttcactgtctgattctcaatcagatagctctgtgtcctggctacaaatatgcttcctgtctttgagggtcatgtaatcgatcatgtcaaaaatcaatattgactagtttcctttttggtttaattaaaacaatccttccctaagagatgagcccctttataaatggagattatacctgagttaatgtgtctgtctgagattaaaactgttaggaaataataacgatggtaatgataattacttgaatgtttaccaggtaacaagcactgtgcttatactttatatgtattatctaagttaattctcatgataagcctataaagtatgtatgattgttattcctgttttaaagaagaggaaattggggtttacagaggttaagtaattcatttgttcattccacaagcatttattgagtgtctgctatatttcagtcacttttctaggagtttgaacacgtcagcaaacaaaatagacagagatcactttgccttcatggaaagtatgttccagtagggaaaacaggaaacaaataataaccatggcaaattagtaagttagatatggtattagatagcaaacagtgccatgggagtgaaataagagatctgggtggaggctacctgtagacacagggtggacgggagtgatggattgtgattttaaatagagacatcagggtgtgcttcattaagatagttatatttcagcagaggcttcaaggagatgaaggaaagaaccatgggggtatctgggagaagaagattccaggcaggggaaatagcaaaggcaaaggccccaaggcaggatcaacagcacagaggccagtgtaggtggagcagaaaggctgatggaaagagagggaaagaggccagagaagtaacaggaccaggtcacaggaccttgaaggccatcataaggacttatttatttatttatttatttatttatttatttatgacagagtctcactctattgcccaggctggagtacagtggcatgatctcagcacactgcaacctccacctcccgagttcaagcgattcttgtgcctcagcctcctgagtagctaggattacaggcacgtgccaccactcctggctaatttttgtatttttagtagagacaggtatttaccatgttggccaggctggtctcaaactcctgacctcaggtgatctgccggccttggcctaccaaagtgctaggattacaggcatgagccactgtgcctggccagaactctttttttcggtttgtttttgagacggagtctcactctgtcactaggctggagtgcagtggtacaatctcggcttactgtaacctccgcctcctgggttcaagcaattctacctcaacctcccgagtagctgggactacaggcatgcgccaccacgtctagctaatttttatatttttagtagagatggggtttcaccacgttggccaggatagtctcgatctcttgacctggtgatccacccatctcagcctcccaaagtgctgggattacaggcgtgaggcattgtgcctggccaggacattttagttgaatgaaattgagacctatcagagagtttttatcacatgcataacttcatctgactgaacctcttagaaggactactctgagaagagtcaaaaccctaatctgtaaggccatacaagtgtaagggccagaattgaagctgattttcttcctaagttttatgctatgtcccctctggctctaaatgttctggagcaatgaaaggctatttcaagtctttttcctttcaatatggtctagtagtttctgtctttgctctgacatgagaagtctcaatagacattttatagtattgttttcacaattcaaaaaataataatgaatatcagttaatattgatgaggcataaggttttactatttgccttgcactgaactaagattataaatgtaccttctcattcaatccccacaatgaagctctgaggcagtcgtacaactgtgatcctgctgtgcagacaaggatctgagacttggcaagtttcctcactcaccctgattcccagggaactcaaccacttaaaaattacccagaagacctgccttgggataggaataacccttcaagccactcctcactgaaaagtctgcaagtccgtaagacagggaaccaagtcacacacttctttttagtaacctctgttcctgggacagtgtcctgcacatagaaaatatcaacatatttatgttgaatgattgatttatgttaagaacaacttctagccatgttaaaacagatctcagaagcaccacatatttccttagaaggtcattctaattccattacaatccacagagcagtgtgttcaatatggaattcctagatgccatgagataatgaaatttcaagtgggtaatgaatttacttttgccaacccactaacgcatactaggtggactcaaatcacaactcagccactcccttccataagttatttacccaatctgggcctcattttcttcacttgtatatagaaatactactaaggttgctgtgattattaaatgatccgatgaatgcaatttatctatacaatgggctggacacagtggctcatgtctctaatccctgcactttgggagattgagatgggtggatcacttaaggccaggagtttgagacaagcctggccaacatggcaaaacccagtctctgataaaaatacataaattagccaggtatggtggcacctgcctgtaatctcagctacttggaaggctgaggcacaagaatcgcttgaacctgggaggcagaagctgcagtgagccgagatcgtgccacgacactccagcctggatgcgacagagtaagactctctttaaaaagaaaaacaaaaaccacaatgcctcgtctattgtaggtgctcaagaaatgttaccttttattacagggtaagtttagaatttcttttcttagcccagagatgctgaagtagatttgagtcagacagaggtaaactttgctgggagacagaaaatccactgtcttctaggccttcagaaatatgtgctataaaggtgctgtatgatggtgtagcatctgccacttgccagtttctgtagtgtaaatacctccaccatgttcaatttcaagttaccaaggtgatgtcacttaacgtggagttgggaagatgtgtgcacaattgactctcaccgactctgttccaactactccattcaccactattttccctccatgctggcctcctttttccagctcggaatgtgccatcagcccaacaggtacaggcttagtcccctctttgctccatatagagacttatctttactacctgcataaacgaggtgattcttactttatttttaaaagcatttataaaatgctccagtctaggcacttcacatatattaactcatttgctcatcctttgagattatgagactattactcctacttgatggaagaagaaaccgaaagccaaagaggttaagtaacttgcctagggtcacacagctagtaaatggcagagccaaaattcaaattaagtggcttggctctgagttcattctcatatccactctcctggccagacacagaactgtggtgggtctgagccaggtcattgcccagaaagaaaagctagagaatcctactggtcactctcaaacccctttgctgggctaggaccagcctagcagtatttttgctgcatgtttcctacttctgtaaactcattctattctgagttggttgtatgccagtcagcattagcaggagcctagaaagtgcctcattctcttctccttttggggaacttatctgatcactgtatcaatcctcctctatgagtacaggagtgaagacactgcggggagccagcagccaagtgctgcactgtgacaagagagcctggggtgcctgggactgaggctctttgataaatattgcttttgcatttcccatagaaggtgcaattcccaagtcttcctgagctcgcctttcataggccggagcagcacccctgctacgtctgggactaggtttccaaaggttgttctggcagccagagcacaacagctgctcagcaatgagatgatcccgcagccccagaggaggaggggtacggtgagccctgctgccctgtgccaagcccagcacccaccagctgcctctcttctgcttccattggagcaggaaagcattaaccctatcagcaccagtgggcaaaggcttggaagaggagcagggtttctggaggttaagttgcttgtaatcacatagctaggagctcagattcatccacacccttttcactcctagaatgtttaacttttgttctgtcttctctggtcatgaagccactctgctgagcattcttttctcatcttgtttcgatactattcttccttttcttttagccagcagcctgcaagccatagtcatttgcaatgcagtctaaccagtaagttataaaaaaagaaaaaaacacacataatagcaagttaagtggattctaacatttagaggaatctataatgattagaaagccccttattatgtcacttctctatcttcacatggagtcattagcattcttggccaccacaaagcatgagcagaaactcagtgaaactcctgctgcttgacagagagaggaatgcttcatcccagatattcatactataccaaaggatggaatggagacttctggattcctacctccgagatccagtgcgacataagccatttggggcggggcctggatccctaaggacaagaagcttttaagccaagcagaaaacaaacaaaacaaaacacaacacagacacagatgcagacatgaataaataaagcagacaaatccacatatgggaaggctccccatcctgttcccgggaggcaggctccctgaggccttacagatgtcggagcagaatctacttacatgttccaaattgtgcatacccagtgcccactgttactctcagaaaattggagtggaaaaggagaaacatctttcacttgaaaaacaaaagacgtcccccacccaaataccaacatggctgtgatttcaccatcattacactgagatttgccccagtggggctttttaataattattccagctgttggctgagttgagaatttgcacagcctcagtggaggtataaccaggctggcctggtcccgggccataaagagaagtgacataagactaaattacctagtgggtttgggggaagtggggaaagagacagataattaatcaggaatcgacaagatgtcttcaaaaacctgtgtctcggcctttatgaagtccttgttcacacaatcttggagaatatacatttataaatataagcagcactgatttttcaaataattgccagctgttagttttctaaaattaattgcaatttttaatggcaaaaaaattaggtttatttggtaggaaaataggaagtttttttttttttttgagacggaatctcgctctgttgcccaggctgtagtgcagtggcataatctcagctcactgtaacctccacctcccaggttcaagtgattctcctgcctcagcctcttgagtagctgggattacaggtgcatgccatcacatccagctaatttttgtatttttagtagagacggggtttcaccatgttggccaggctggtctcgaactcctgacctcatgctccacccaccttggcctcccaaagtgctgggattacaggcatgaaccaccacacccagccaaaaaaaggaagtttataaaagagaaaaatatatttttctgcacaatgatgatttgatatttgtgttttccattgagtttgtatgtatgtgaacatatactgtaaataattgtaaatgcaatttgtattctatatttcattgcctttttcattcattttacttcacagtttacatatttttcacctatttggagtcttcagagtgaccagtgtttaattgatacatatttttccagttagtgaaaattccaccattccagccattctcttgtaatcaaatttttaggttctgtccgtgaaccatatgttcttatgaattcaagttttggttctggtgaattattttcttgggacaaattccattgagaaaaatgactgaataaaataaaactaattctgtgacttttgttacatgttgtcatgctgcttcccataaaggcttgcatgggttttaaagcaaggtcaccataagaataaatagacaaaacttataaaaattttgtcagctctggacatcactgtttttttaaatttgtttttattttaggcacatttaaaatcttctccagttcttactctttatgatatcgaatatgatactcattaaaataattttttaaaaaaacaactttcattacattttactctaggaaaacaaatccactttattttagaaattccaaagaattccatccagatacaatgtaattcataccaagctggaagagggtgcttgaaattaaagactatattttctggtagggtggggcgtaatgccacttgttaaaagataattgctgtgttgtaaaacgtcagctaggcacttctgaagaacagaccccttaatctgaagagaccgggcgtggttctctaaatgtggaaacattttcaaaaaaaatcaacaaaagaacatctctctggctgcttggggttgctttctcaaaggcagactatgattctggcaagataatgagacttagagttttagggccccggatactctatatacataccaccattaaagctactgcttcttctgctaataatattaataataataatagttactctagagagataagaaaaacccaaagtgtttttttcctattcacattcaccactcaacacaacacttctgatattagatgtgtggagttctggggggaaaaatacatcaaccaagcaattttgcatagactcccaagtgggtgtcttctaattcaagtcaattttgacactatatacccagagataccatcaaatcccacaagcgtgggctcagtcagtcccacaagattgatccccacttcagattccagtcacacatagtaggttttcacctatatttctgacccatcagctataagttgggggttcgttcccatgacccccttctcaggcttggttaatttgctagagcaactctcagaactcagggaaacatttgacttatgtttacacatttgttataaaagctattagaaaggatacaggtgagcaaccagatgggagggatgcacagggagaggtctagaagaagggacatggctcccccatcccctctctaggtgccaccctctaggcacctccatgtgtccaggtatctgggcagctgaaccatagttcagggatttttatggaggcttcaccacacaggcatgatcgactattaagtccatttctagccccttgcctccctctggagaatgggaatggaggctgtaagccccaaacttctaatcctggcttgggctttctgttgaacagcccccatccaggagcccagaaatagtaccctcattagaaagaaaatactcctatcacccagaaaacaccaagggatttaagaactctgtgtcaggaactgggatcaaagacaaaatactagaacaaaagattgtcctagcaccactattgcttaggaaattataagagttttagaagctctatgccaagaactgtagtcagagaccaaatatctatttcttattatattacaatatcatagctaatatttattgagttctcactatatgctaaagagtgtgctaagcactccagtataaatgatctcacttagtcctcataacattattatgctcacttgaagagtgatgaaacaaaagcacataggcttagaaacttgctcgggccacacagcccattcatggacacaaacctaggatatatgaaaataggctttgatttccgcagccacactgtggtttatctcttttggtaaactttcagttaatagctccatttttacttccccagaaacttgtaacaaatccatatgttggggataaggtggagtgccatggtgtcttatacacatcctccatctttattagccaactgtgaacttagcaccagccctgggcatctcaggcgtgtcctctgtcaaaaggagacttcattcacctgggcattccttcagtctctggggcaggttttggctcctttctccatttgaaattatttgacttggtatccaattttaagtttaaagctttcttttcattgactctttcagaaaagccatcggatccctttgcgaaaggaaaaacttctagtggctcaactgagcatacttggtttcttcccaatagcacgtttatgagagtgtcttcctgagagcttcatgataaatactatcatcaaatagtagccaaggactaaggtccaattcaaactctacccttccaccaactggcccacatgagcatatgttcctggtacagcactaaccttagaacaatcatttatctaaccatttatctctctttccatttcctggccataagagtatgagaagtcatgctatatttttaggaaatgttacaaatatatttattagactaaggaagttcttgaataaagccatcacaacttatgttggatgaaaatgtaagagaacatgtcaaatatatcaagttcaatacacttttagttttgttttgtttcattctttttccagataaatgaaaatttagaaatttattacatcagagctacaattcaagggcctgtggaagataacttttcccaccaagtgcttatttcagtcaaatgtacatgaccataacattatactttaaaaggccaaagaaaaaataacttaatttcctcgtaccagtatttttcaatatggggtcagtgcagcaaaattcattgggtatctggctaagtgccaattcctggtcttattccaggcatatcaaagcagaatttctggaatggaggcttaagaaccttagattttgtttcccttagttaatcttattgaccattattcactgctctagcatctcccctcatgttgcaggctcagaggaactgcatacaaaactcaagtgccagaaacaatggaagctgacctggtatcaatgcttctcctaaaatgtgggaagatttctgccccactctaggcccttctgtctttccaacactttctgtaaaattcacgtaagtcaggagaatttctgagtagattaactatgacacaaaagacttctaggtggccgaacctaccatagaataaatgattttatgaaacattttatgaatgatctcaaacacccctgctgatcctctctaggaatgaaaatgaagggatgataagaatttaaccagtagtcctgagagaaccactgctgacagagagatgcagggtggaagagaggttagataaaattttaaaaacacctgcctgactctgtggaaggaacagcaagtcacttctaatccctggagttatgctgcctcatagggaagtagagttggattttaaatgagaattttatgagacattcttgatctcatatattctatactaggacccctttattgtactaaggcctattaggtcatgggtaccaattatttgtttagaaaacatcaccacagtaattacaagagatccttgagctctttgatttgttcgggctttgttttagagggatgcgaggcaagaacattattgtaattccttaagtgagaaatcctgcctttcttctatgcatctagtttccaatcccattgtaaggatgtgaaataatcaaaatcaacagcacctttgattagtcactcatttatccttgaattcactcatttgccaaattcttattgattacctcctatatggatcacaaaaattctcctcattgttggggaaaaaaatgtaaccaacaggtgcagtccctgcctacatggagcgtatggtctgaagagggagtatataagtaaataggcaaatttaatatggaatgagtgctatgataggattaagtctcaatgaaagggagccaactatgagaacaaagaaagggagagctagagacaggagacttgtcaggggtctttggcaaccatccaggtgagagtggcaccagtgagcatgaagaaccattgatttcctttgatgtttttttgctcatttttctttctaaatattggagattaggcagagcctaatcactcacctctgttaatggcttctaaccaattaatcagtgtacataagccagatgtgaaccaaaatacatcatgcgctagtaaagctgggcttcctctctttcactccagtttgaacttatccactcagctctagggcaggcagtcaaaaacagaaggagtcttctaaagaggagtcacatccaaccctgtattatggccacagttttccatgccccctgtgttcatgcaccttggttgtgtcctcatagaagactctgggcttggccttacattctgcattgaccaacaggatgtgcaggaaatgacattggatctgcacgcagccgcaggaagacttgtgctcttttttttaacactcctttgaaacctcaggtactttgtaaagaagcctgggctacattggtggaggataagaaaccaagaggaaaagagccaagttgtcctatccaaggtcatcccaaccatgtgaaacagtccagccaagatgagaagaggtgtttaccacagttggcaaccaatgtatcagtgagcagagatgaaatcagaagatccatctacttgacccatatacttgtgaatgataaatgctattgttttaagccactgagttttgatgtggtttgtcacacagcaatatctagatgatatatttcctgagatctaagagattcaagatacagagacaagacaaagaagaactggtactgctattttatgactgtaactttgtggcttatattactatggccaagttcccataaggttctctctggtttaatcaaccatcaaaaagaataaaagaaatcagagagagagaggtcacatatttcctctgacacttcttgagccaggatctgaaaaaagtcttacctggaggaagaacttctttcttctgtgtacctaagtcattcaccaccataattgcattcttagtctccttgtgaataacccattaactcagataaaccactctttagtgaatataataaactcatttaagagctgtgcattggctaggacaaaaagaaaaaaaataacaataacacagaaagttaaccaaagcttaactaacagacttttcatcttatttctttatttctctcctaaaacagtacccatgcttgagtgtaacaaaatatatgtaaaaacaagctgtcaggcttctgacacagtagatgcctagaggcaaatatttctgctaaaagttttgatggagccctggggagaggaggaaagggtcccaagctgagagggattggcagctggctgggagcgcaacctgacgctcccttcccatttcacaaagaaggttttgtttggattgtggggcatggtgagtgactccttagcaccatggggttatgctgggtcctgggggaacatctgggctgccatttcaagcaaggctgaaactctatcctggccagagctgctccaatgaatcaggtgtaggtgtatttttccaggatgttcaaaaccacatcttacccagagaaacagggttttgtccatagaagcctcattctaaagggcaagcaatcttccttggtccccatgaagggtatgtttactgaggcttcatgcccaaagaatcaaatccaataactgaaagtatgacctccacacatgcttttcaaagtatgttaggaaccctcaccaataaaatctctattctcactccatgccattcccaccttgtgtttataacacagtttcaaaagatcgatccctcatttggagctgaaaggttgcattttttttattttaagttctgggatacaagtgaagaacatgtatgtttgttacatagatatacatgtgccatggtggtttgctgtgcctatcaacccatcatcttggtttttaagccccacttgcattagctatttgtcctaatgctctccctcccctcgccctccacctcccaactggccccagtgtgtgttgttcccctccctatgtccatgtgttctcattattcaactccaacttatgagtgagaacatgcagtgtttggttttttatttctatattagtttgctgaagatgatgacattcagcttcatccatgtccctgcaaaagacatgatctcattcttttttatggctgcatagtatttcatggtgtatatgtaccacattttctttatccgatctatcactgatgggcatttgggtccgttccgtgtctttgctattgtaaatagtgctgcaataaatatacatatgcaagtgtctttatagtagaaagatttatattcctttgggtaaatacacagtaaagggattgctgggtcaaatggtatttctgattctagatccttgaggaattgtcacaccatcttccacaatggttgaactaatttacattcccaccaaaagtgtaaaagcattcctatttctccacagcctcaccagcagctattgtttcttgactttttaataatcaccattctgaccggcatgagatggtatctcatcatggttttgatttgcatttctctaatatcagttatgttgagctttttttcatatgtttgtcggctgcataaatgtcttcttttgagaaatgtctgttcatatcctttgcccattttttgatggggttgtttgttttttctcgtaaatttgtttgattctggatactagacctttgtcagaggggtagattgcaaaatttttctcccattctgtaggttgcatgttcactctgatgctagtttcttttgctgtgcagaagctctttagtttaattagatcccatttgtcaattttcgcttttgttgcaattgcttttggcatcttcgtcatgaaatctttgcccatgcctatgtcctgaatggtattgcctaggttttcttctagggtttttatggctttggtttttacatttatgtctctaatccatcttgagttaatttttgtataaggtgtgaggaaggggtccagtttcagttttctgaatatggctagccagttttcccagcaccatttattaaatagggaattttttccccattgcttgtttaccaaagatcagatggttgtagatgtgtggtgttatttctgaggtctctgttctgttacattggtctatatgcctgttttggtatcagtaccatgctgttttggttattgtagtcttgtggcatagtttgaagtcaggtagcttgatgcctccagctttgttctttttgcttagaattgtcttggctatacatgctcttttttggtcccctgtgaaatttaaagtagttttttataattctgtgaagactgtcaatggtagtttgatgggaatagcattgaatctataaattactttggccagtatggccattttcatgatattgcttcttcctagttatgaggatggaatgtttttccatttgtttgtgtcctctcttattttcttgagcagtggtttccagctctccttgaagaggtccttcacatctcttgttagctctattcctaggtattttattctctttgtggcaatcgtgaatgggagttcactcacgatttggctctctgcttgtctattgttggtgaataggtatccttgtgatttttgcacattgattttgtatcctgagactacactgaagctgcttatcagcttaaggagttttttggctgagactatggagttttctaaatatagaaacaggtcatctgcaaatagagacaatttgacttcctctcttcctatttaaacactttttctcttgccttattggcctggccagaacttccaatactatgttgaataggagtagtgagagaggttatccttgtcttgtgccagttttttaagggaatgcttccagctcttgcccattcagtatgatattggctgtgggttgccataaatagctcttattattttgagatatattccatcaatacttagtttattgagagcttttaacatgaagccatgttgaattttattgaaggccttttctgcatctattgagatgattatggggtttttgtcactggttctgtttatgtgatggattacatttattgatttgcatatattgaaccagccttgcatcccagggatgaagccaacttgattatggtgaataagctttttgatgtggtggtagattcagtttgccagtattttattgaggatttttgcatcaatgttcatcagggatattggcctgaagtgttcatttttgttgttgtgtctctgccaggttttggtatcaggatgaagctggcctcataaaatgagttagggaagattccttctttttctattgattggatagtttcagaagaaatggtaccagtttctctttgtacctctggctgaattcaactgtgaatctctctggtcctgggcttttctttagttggtaggatattaattactgcctcaatttcagaacttgttatttgtctattcaggtatttgacttcttcctggtttagtgtgggagggtgtatgtgtccatgaatgtatctatttcttctagattttctagtttatttgcatagaggtgtttatagtattctctgattgtagtttgtatttctatggtgtcagtggcgatatcccctttatcattgtttattgtgtttatttgattcttctctcttttcttgtttattagtctagctagcaatctatctattttgttaattttttcaaaaaaccaacttcagggttcatttattttttgaaggattttttgtgtctctgtctccttcggttctgctctaatcttagctatttcttgtcttctgctagcttttggatttgtttgctcttgcttctctagctcttttaattgtaatgttagggaattgatttgagatagttctagctttcttatgtgagcatttaatgctacaaatttccctcttaacactgctttagctctgtcccagagattctggtatgttgtctctttgttctcattgatttcaaagaacttcttgatttcctccttaatttcatcatttacctaggagtcattcaggagcaggttgttcaatttccatgtagttgtgtggttttgagtgagtttctcaatccgagttctaattttactgcactgtggtctgagagattgtttgttatgatttcagttcttttgcatttgctaaggagtgttttacttccaattatgtggtcaattttagaataagtgccatgtggcactgagaagaaagtatattctgttgactttgggtggagaggtctgtagaaatctactaggttcacttgatccagagctgagttcaagtcctgaatatcttcgttaattttctctcttgttgatctgtctaatattgacagtggggtgtaaaagtctcccactattattgtgtgagagtctaagtctctttgtaggtctctaagaatttgctttatgaatctgggttctcctgaattgagtgtatgcatatttaggatagttagctatttttgttgaattgatccctttaccattatataatgctcttctttgtcttttttgatctttgttggttaaagtctgttttgtcagagactaggattacaacccctgcttttttttttttgctttccacttgcttggtatattttccttcatctctttattttgagcctatgtgtatctttgcacatgagatgggtctcctgaatacaacacactgatgggtcttcactctttatctaattttccagtctgtgtcttttaattggggcatttatcccatttacatttcaggttaatattgttatgtgtgaacttgattctgtcatcatgatgctatctggttattttgcacactagttgatgcattttcttcatgctgttgttggtctttatattttggtgtgttttttcagtggctgctaccagcttttcctttccatatttagtgcttccttcaggagctctcgcaaggcaggcctggtggtgacaaaattccttagcatttgtttatctggagaagattttatttttcctttgcttatgaagcttagtttggttgaatatgaaattctgggttgaaaattcttttctttaagaattttgaatattggccaccactcacttctgacttagagtttctgctgagatgtctgcagttagtctgatgggcttccctttgtaggttacctggcctttctctctggctgcccttaacattttttccttcatttcaaccttggaaaatctgaggattaggtttcttggggttgatcttctcgtggagtatcttagtggtgttctctgtatttcctgaagttgaatttggcctatcttgctatgttggggaagttcttctggaaaatatcctgaagtatgttttccaacttggtttcattctccccatctctttcaggtactataatcaatcataggttcggtctttttacatagtctcatacttcttggaggttttgttagttccttttcatttttttttctctaatcttatctgcatgccttatttcagccagatggttttcaaactctgatactctttcttccagttggtcgattcagctatgcttcacgaagttcttgtgctctgtatttcagctccatcagttcatttatgttcctctctaacttggttattctagttagcagctcctgtatccttttatcaaggtttttagcttctttgcattgggttagagcatgttatttcagctcagtggagtctgttattacacagcttctgaagcctccttctgttaattcatctatctcatcttccgtccagttttacgtccttgctgtagaggcattgtgatcatttggaggaaaagaggcactctggccttttgggttttcagtgtttttttcgttgattctttctcagctttatgagtttgtctagtatcaatttttgtggctgctgactcttggatgaagtttttgtggggactttttttgttgaggctgttgttgctttctgtttgttttacttgcaatgtgcaggtccctcttctgtagggctgctgttgttcgctgggggttcacttcagatgctattcatctggctcattcctgcactgggagatgccacaggagaaggttggagaacagcaaagatgattgcccgctccttcctctgggatctctgacctcaaggggcaccaacatgatgctagtaggaatgcttttgtatagggtgtctgaccacccctcttggagggtctcacccagttgggtggcatggggagcaagacctgcttaatgtagcactttgtccctccatggaaggggtgtgctttgctggggggaaacccactcgtctgggctccctggattcctcagaactagcagaaggaaagactaagtctgctggtctgtggagattgctgccacctcttcccctaggggctcaggcccagggagatcagagttctgtccctgagtccctggctgaagttgttaaagttcctgcagggagtccatgctcagtgaggagggatgagtcaggtttagggcctgaagaggcactctgtctgcagtctgccacagctagtgtgttgggctttgggggatacctcttggtactaagcggtccagcctccctggctccagcaggggaaaagcggggcctggagctttagaaatgtctgccgcccttcccctaccctgggagcttagtgtgttaggcagctatcagtctcagtgttggctgttgcccctccctgaaggagctcaaatggcttacacagcaagcagccacagctgtggtgctggtcacccctccccactgggaccttggcaagcttaagcagattctagctgagtcgctgttgagaatctgcatggctccgtggctgggaccctaggccctggtggcatgagctcatgagtgtgatcttctgatccatggattgcacagttctgtggaaaaacctgttttcccaggctaggtagcatgctcactcactgcctctcttgcctgggggctgactgctcccctgccccatgtggctgtcagatgatccactacaccacactggtcttctttcctctctgtggataatgccagccgcttagtcagttctgatgagagaacctggatacctcggttgctggtgcaggatttgcagaccattacggttcttttcaatgggagcctctgatcgcattgcttctagtccgccatcttggccccatccctgtgaactgcatttttaaacacctgtttttttctactccaaggacattttccttaacattgtcagattctccacttcttatgccactttgacattgttctattgctaatagtaacacttctattcttatcagtatatgcatttaaaaatcccttaatatttaaaaaatttttacatggatgagcttaacttgatgctgttgatgaatctgaaaaaacttaaatgttatttctgtattctgtgacatcttaaggttggtagagaaagtgtggttggtaaagaaagtgttttattttattgtaaatttggtaactgattcacagattgagattgatctaggaccacattccggagtcttaatgtgagtcattaagagtggtttattggtggctggaagattggcagcccagggggaaagggccaggacagctgccatggggaagagcaacaaagaggacgatggggagatatcatgtagaatatggacctgcactcatcagcaaagagctccagccagatcttggaatagcaggctaaacacagaccaaagacacagtaactaattgagccttcctgcaaagtataataattgatgtaaaacttgtttaggagtggcaatttatgggaaataccaacataaaactaatttttacaaaacatggaatatggaggtcagattataacatttattggtgaactgattccaattattaacaaaattagaagctcctaggtgtatgcacatctgagtaggtcaattaacatcatacttacctcgtaacctactgtattagatgtctgctatttgctgcccccacatttagttctcttcaagtaatcatagtgtcctgattctactttggggattaacctcttttccattcccgctttcgtaattagatagcgagggactccagcctcaaatgtagatgtgggcttatactggcttaagtcaataagattaatttttttattgttttgtcttgttttaattttttttgagacacagtcttgttctgttgcccaggctggagtggagtggcatgatctctcctcactgcaacctccccctaccaggctcaagccattcccccacctcagcctcccaagtagctgaggacacaggttcacaccaccactaccagctaatttttgtattttttgtagaggcggggtttcaccatgttgcccaaactgatctcaaactcctgagctcagcctcccaaagttctggcattacaggtgtgagctgccacacttggtccagatttttttttttttaatcactgtgattggctcaaagttggagatataacaaaatcactaccaatgaagttctaaggggatatttcatgtgacttctggcaggaaaggacatttcattcacccttccaacaaatattttctgaacaagctgggtgcccagtcatggctaggattaagagatattaatggaaagaaagcacactctctaccctcaaggtactctcaacggaggacacagaactatgagtaaataattagaataactagtgctgtatctggggtatcgatggattgcaataaaagcaaaaagtgagggattatccttagtgttcatgtttgaagaaaagctagatgggaaatcacttcaatatgtagagacatcagcagaaatttccaaaaggatatggtgtgaggcttagggttttctggattcctattggcttcagacactttcttcctggatcttctgatttgtcagatagcttgtgtctgtccttgagagatctccatttctgattaggccaaatgatttattttccagaacttgatttgctaatatgcaaatgtctgggcacccacaaaagaagttgtctcatcatctgaccaatcatgcctgttcaaaagatgaataccggtttttggagccaagatggctgaataggaacagctccggtctacagctcccagcgtgagcgacgcagaagacggtgatttctgcatttccatctgaggtacccagttcatctcactagggagtgccagacagtgggcgcaggtcagtaggtgtgcgcaccatgcgcgagccgaagcagggtgaggcattgcctcacttgggaagcgcaaggggtcagggagttccctttcctagtcaaagaaaggggtgatggacggcacctggaaaatcgggtcactcccacccgaatactgcgcttttccgacgggcttaaaaacagacagccaaatcatgagtgaactcccattcacaattgcttcaaagagaataaaatacctaggaatccaacttacaagggatgtgaaggacctcttcaaggagaactacaaaccaatgctcaaggaaataaaagaggatacaaacaaatggaagaacattccatgctcatgggtaggaagaatcaatatcgtgaaaatggccatactgcccaaggtaatttacagattcaatgccatccccatcgagctaccaatgcctttcttcacagaattggaaaaaactactttaaagttcatatggaaccaaaaaagagcccgcatcaccatgtcactcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaatggtgctgggaaaactggctagccatatgtagaaagctgaaactggatcccttccttacaacttatacaaaaatcaattcaagatggattaaagacttaaacgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggagggactgtaaactagttcaaccattgtggaaatcagtgtggcgattcctcagggatctagaactagaaataccatttgacccagccatcccattactgggtatatacccaaaggactataaatcatgctgctataaagacacatgcacacgtatgtttattgcggcattattcacaatagcaaggacttggaaccaacccaaatgtccaacaatgatagactggattacgaaaatgtggcacatatgcaccatggaatactatgcagccataaaaaatgatgaattcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcattgggagatatacctaatgatagatgacgagttagtgggtgtagcacaccagcatggcacatgtatacatatgtaactaacctgcacaatgtgcacatgtaccctaaaacttaaagtataataaaaaaaattcaaaaaaaaaaaaaagacacttcatgcaacagatgtacaaatcagatactattatccccatttgacagatgaggaaatggactcttcaggcaatattaaataattttattaaagtcacaaaaccaaaaaaaaaaaaaaagatgaataccagggaggatattttaacatctgatgaaaggctactaaatagagataactataagaaataaaaatgaaaattataaagaataatcaagtaataaattaatatataaataccaaaaatctgggaagttttctgagctgacttagaactttaagaaatgctaaaacaattatgaaaagcagaagtgataatattaatgggttcggatgggtagacaataaaatcagaggtgataatattaatggtattgaatgggtagatattagaacctgaaccacaaaaagaaggtgttggaacctaagaaaacacaagttaaccaattttttttcttgattttatggtattcaacaaacatttattgaatgtctaagtgccacgaactggtaactgattccttgaactggcaatcataaactgagctggaaagtagaccactgaaagtaattttttttagtggaaaaccaaaatatcaggccaagataattacactgaactatacattaacaaagaacctttgctgatggggcacagtggctcatccctgtaatcccagcaatttatgaggccaaggcaggaggatcacttgagctcaggagttcaagcctagattgggcaacacagtgagacactgtctctacaaaaaatacaaaaattagctaggcatgagggcacatgcctgtggtccccactacttggagggctgaggcagaaggatctcttgagcctgcaggaggttgagaggctacagtgagctgtgatcctgacactgcactccagcctgggtgacaaagggaaaccctgtctcaaaaaaaataaatagataaaaaacaaaaaagaaagaaaaaagaaaaagaaaaaaagaatttttgctatctacttgagttaggcaacagatttgcattttcaataagttcctgttattgctcattagtaaattatgtcttattttttattataccatctgagtactggaaagatcacattgctatatagggaccttggcagtctctcaattttgcatgtaatatgtttagtgtgtcagagcacgcatgtacatagtatgaaactaagttcattttctatgtatttatcattaaacctcaggttttgaagtcagcaagatccaaactagcattctgcctagcttagttacttgcttaggaaagttatttatattttctgagcttctattgttttgtctcttaagatggaggagcaatacttaaccttcagttattagaatgactaaataaagtttcttcttaaaatatagaacactgtgtttgacacatagtagggcctcaatgagaatttaatgaatgagcaaataaacgaatagataaataatagaaataaaacaagacagaggaataatatgtgtctagatttatttattcatttatttcttggaaaccatttctcaccacagaaaaatgttaggtacattataggcaggatgaatagatgtcttaaaattcatgctatattcttaattctggttaatttattctaatgaaaattatacattaaaatcatcacaaaatataatttaagttgtgtgtcaagctgtactttttcatagtaatgaatttatttttcagggtatgctgtgtgcatatagtttatttacatatttagatatatttcctatttataatcagaatttgaattattgggccagtttttagctaaatagtttatagctaaattgtttcccagtaagttttctagtttttatctatgagagggccaatttgcctgcatcctctttaaattatttcttaggtcaaagggatatcttttccttaacaaaaaatgttttaatagtttacatcaaattcactgaaactatatatcatggctaatgaaacaggctttactaatttttaactacacttcaaaaaatttcttggataagatagttgggttcaattatcatacagaaaatctgtgatagtagcagcaaaattttaaaacaatagacactgatgtcccaactggcaccctaacgactatgaatctttaatacctaccattgtgttaagcttcaagaaatgaggcagagaagaggagggagaagacacagtatttcagtgattctttacaacttgacaaagtgttattatgtcatctttcaaatccataagccattattttgcaccttggggagcaatacagtagtgctccagatcccacagaatcacttatccttaaagtcttcatatacttttctcagtctatccttctctcaagggaaagcaaacttctctagctttgggaacgagtaggtcttaggtgtcagctatcacttctccagaaacaggacacaagataacaagcaaagtgacctttgcaactgtctttctcaaaggaagctgagtcatttttctctaatttggtttaaaaaaaagatgtttttattatatcgagagtaagcaccataacttctcccatggaggaagtttttcttgtgaaaataccttcaagaggcattttggcgtggatgagccggagtgtggtagattgattgcaaaaaatagcacaaacatttcccctccctgtactcatccccttgcaatatgactttgcagctcctcccctcgagacaaaactctatttgtccaccattaaatctaaactggttttgtgacttcctttggcaatagaatgtggtgaaagtgacaatctaccactccgaggctaggtctcaaaggcttcttcatgcattgtgctggctctcttgaaaccctgttctgctatgtggatcagtccaggctactctgctggaggaggtgcaacccatgacccaagcatgtgcatttccatagccagtattcagccaaccattccattgaggccattctagattagccaactcctacctgactgcgaaagtgagcaaagccagctgggatcagctgagcccaacctagagacatgcaactcacaaatagattagtgaccaacaataagggtttattttaaagtccctgaaatttggcatggtttattactcagcattaactaacagatacactcacaagcaggaatagcagtaagtatcaggatatcaaagactgtgggaagctactctacagtagcaacaggggaatcatgttggctgttgctgatagttgctcaaggtggcataaagaaaagagatgaggatgagaaggggagaagatctaacaaaatggggagtatatgtgattatatttggggggcccagggactgttaacagtgacaggacggccaaaaggtatgtaagaatgatgagttattgtgttgccagaaagtgagcatccactccactttgccttctgtgtttttaacacaatatatgtaactgattaatgcagcacaagaatagatagagatcctgtccttgtttgtgaaaactaaagagagggctgatcatttctactgggtaaagtgatgtgatacaaagatagcatgcttggacataagaccctacaatgctgagccacctggaggaatatgactctccatttccatcccctcacacggaattcacaaggaatactgaagagtgttaagacttccacagaccattgaacccattaggtgggaagaagggaggttgagtcatgtttagcttcctctccagtggaacagagatctgcagctggcatctgaatagcattcctctcatgtaaagggtggagggaatgtgtcaacaccaactgaacacctaagccttatctcatgtaattctgacaactgcacaaagaaattatttgttatccggattatgcttaaaaggaaactaagtttcagagacattaaggagcatactaaatttcactcagttggtgagtgataaacagtattttaaatccaagattgcctgaccctggcccaataatctttcgattccaccacaactgccagaaacatctatccacacatcaggtgtatccacagctgtttggtttgttgttgctgaaatttaagtataacacctcccttagcaactgaaaaggcccttagctacctgcaatatttaacaactactttctacataaatagcttctgaaggttttatcttacagcatagtgggttcatgacagcttttatctgagatgatgaaacaacaaaaatgcctggactatgacctagagcctgcccgggaggtggttggtcaggtgtagtctcttgggaagtgctggggacacagatgttccagatggttgagacatttctttcactagagcatggagtgtagaattagccaaaatacccaacctctaggaaggaaatacagatgttctaaaattgtggtatccaactcttacttttcagatttctaggattcaacagaggttcctgagaggccattgcaaatgtcagggggaaaagtaattcaattaacaacaacaacgataacaacatagcttataattgaatatcaccaggcagtgttctaagaattttgtgtaaattaacacatttaatcatgtttttatccttatgggctacatataacattatcaatagcctcattttacagatgagtaaactaagacaaagaggggttaaggaaattactcaaggttttgcagtaagtggtccaactagaattttttcacaggcagttttgtttcattgaccatgctcctactcaccataacgtactatttttcaggcagagaaagtgtttatttttttaattgcacacacacacacatacacacagacacacactcacacacacacacgcacacacacaccttacatcttcatgggattagtacattggaccagcaggactcacaggatgcaataccaaagcaacttcatttcccccgtaattgctcactcaaacctgtgccatggatcagacctttccctaaccctggatgaactcctgggcagaaaagaccacacagcttccagattccctctgaaataaccaaagaaactccaggcattttagttgcctaaaatagtgtctgttcactgatgaatatcccgagtccagtgtaatatttgaaattctgagtttcactcaaagttaaagcctgtcccttcacttgaacctgcaataggttggaaatccactgatggggaaagagggactttgtcttttctactctgttgtctccttccatcccctaccacagcctggtgttgacttcgaacctcctggttgaagccaggagagaaaagaggtggaggcttaaaaataccttaattgatgagcacccatatacagatcgtttcatattacattgcaattgtgaaggtatttcaaaatgttgtttacacttatcaatgttttaaaattatgaaaataatgatagttattaggactgatgctaaatctggttatttaatgttataaaaattttgaaatattttgataactctacttaaagaggattcctttggcaattctatggatttaatttatgtacttaaaaacagtaacctaagaaggggtcatctattgccaaagactgctgagagagtttatagcataaaagcaccttggttttgggggtttcttctccaccatataatgtctcaactgttgtcctatctcccttccagacaaccttcttgggtaaagtccctttaaggtgataagggccagttctcttcctcctgctcatatggctgacatctccatgggaaacatgcacctttaccagtgcttggcagaagtgcaggtactctgtaaccccagcagcccctactccatccgctgttcaggtctgctagttaactggtatgccctagtagggcgaactggctttgcatgtttgaagtcctcttgtaacaattggtaaataacttctgctctgagctcccgtcaaatcctctgccaatacccttgcctcctcagcctcttcccaggacctccagacctcccactattcaggaacctaaaagaaaatacttggcaaagccagaccctgcaagagctgactccaaatgcacaaatgatttcagttctcatttgtcagtgctcgggcctcactagttgttggaaccctgtgaaacatccgcactattcattacatccaaaggaagcaatctaactccctaattgggtttttccagcctctctcactagacttgaggcaaggggaccacatcccctacccaccccttcttggaatggcagtaggaaaaatactccaacacattttcccaaagaaattctctctttaatctagcacctcaatctttttatacctttcatgtggcttttgaaccttatatattgagggtccgtattaaatgttcattcactgaaattactgctgacaatcaatccctacacaccacacacacacacacacaccacacacacacacacacctaaatgtgcttggctataagaatttcccatgcagcagactattgaactacagatttttcagcattggcatttggaaaaggctcaaacctgaaggcagagaaaactaatagcctaaggcctccaatctaaagatagattctactaatcctaggctggctgccttgtacagctttgcaatgtctcctccacatgtgagcctggcccgcttgcctctcctgtttctacattctcagttccttggctggctcccccagggataactctcagtgcctgcctgatctgtgttacaaagcagacatgaatagccaggccagagagccatgtactaatttcctgggtggccaatccctctctctcatatcctagtgccattttaagggaaaagaaatgtaggacatggaataaacagagggaaacctgcttgatttgttgttaatgtgtcagtgttttgttttgtgggtttaacttgtagaaggcaggtctttgtcttgttactctctggcatttaacagggcctgccttcagtgactcagccgggtttccttagacagaaaacagccacttagtgccttttacaccaccaagaaaatgagattattccttgaggagatcagcagctctcggctgctgtcgaaagggcgctttgcctgtttgtttggctgaaaggcaccacgcagcccaggcttgtttaaaattagcttcctcataaatcacttgcacaatgaagtgtctgcctctgccctctgacatatttgtgtctctgtttatttttaatgatgacatggctttttctgtttccatttggctctttactctccacactcccaagcactaacttctgtggcaaaagtacaaaatctaagaaactgcagggaagaaagagttccttttctaccagcacataaatgtagtggggaaactgagttagccttgggggtatttctggaggaaattgcctcctttctaactttgtcagattataatatcctgaaattgtactttttgaaagagtaagagggtgatggcaatattctgtaacttgataggggtctgtgttacacacgtgtatgtgtttgcaaaactcaataaatgtatatgtaccttacatgtaagtttttacataaagaaaaaagtaaactaataatgaactctaataatatttatacagaactatttaagaagaagtatactagttttctcaatttactttgaaatgcatccaaaactgtgataaattaattgatggatagatggacagacgtgataaaacaagtagaaaaaaaatgttaaaggcaaaatatagatggtaggtacaagtctgttccctgcaaaattacttcaactttgctgcaagtttgaatatttttacaataaattattagaataaatgctctcttggtgacccacactgaatccttggaaacatcagagagccacagcttctaaaatcctgtattccacccaaattttatttttaaaaatctatatttatatagagttaaattgcaataatttatgacaacaaggaaaacagtatccttgacccagtaaaaagtacaaaatacagaatattctaagagagagggaaattttattagttagacacataagaaccttcttcaatttaaatggcatgtaactagaagttcttaatgcagctctctaatccaatatataaaacacaaatgaagaacagtaaagggcatacaatgaccaaaacccacataggatgaattcaaatgggcctggggtgagaaagtccaaccttagtgaacccacagttactgttgaaacaaacaaacaaacaaacgaatacccagaaaagtctgaaacaaggaaaaaaactggagaattcttctatgaatgctacctttttgaggcaaggtcttttctttctttctttctttctttttttttttttttctgagacagagtgtcactcagtctcccaagctggagtgcagtggctcgatctcggctcactacaacctccgcctcccgggttcaagtgattctcctgcctcagcctcccgagtagctgagactacaggcgtccgtcaccatgcctggctaatttttgtatttttagtaaagacagggtttcaccatattggccaggctggtctcgaactcctgaccttgtgatccacccgcctcagcctcgcaaagtgctgggattacaggtgtgagccatagcacccagctggtgagacaaagtatttttattttcttattacaacttttggagactttgacttccagaaaacaaccagataattagaaaagaagagctcttagcacatattgccatggtacactgaaaaattacactgctttggcaagaatgtggacaggaaaactcatggtaacagtatattgcagaggtagtagtttgttgtgcatttcttttcttcagaatggcagttggagttgaaaaagccacctctgcagcagagctcaataatatgaaagttgattattttccaatatgatattggaagttgttctagttattgtacaattaacctgtcttctggggaagggaaatatactcctcccgtggaagagagtaaggaaatgaacaataagctaataaaccttaatatctaaatgagtttcttttcacaaatgaagaccatgtacccttattgacaaacaccagctcttgataaatgtccagtttactcattcatggatgagtaaactgaaaaatattttaaaatatatttaattggctataaaatacacctacaaagtaatcttcaaagacaagtcttaaaaatgacataagaaaaagtaaaaggatcagacaaaactccaaatcatgcaaaaacagtctgcatttgaggtggtaaataaagaattaacactacttgaacttaagatgtgaacataaagtacaatttgaaaagttctcaaaaaacattgatgagaaagacaaagggagggagagaaacaggatacaaaccatagacttgaatgtattccgcaggaagtacccaaactgaaaggaaacaacaaaaataaataaataaataaagtcagagaaaaggtctgagagcacattgccaaggagtcaatagcatttcagggaagttagtgaagaggagccaagtgtggttccctgcacagcagccatgcaaaatgagttcaaaggttaagaaaatgaggattggaaagttttgttagcttgaccaaagcctagatctagaatgggatctcaggaattttattatcagaatcataaatcagaaatatcaagtctgtaatattatttgaaaatgctgaagtgccacaagtgaccattttgagactgaactcctcaaagttgtcacctctctctgaaactcattgtgctttaatattcttgccccattgccagggaacaactaaataacttcctttgctttatttcattcatccatttctccttacaagcagcattaatgttgtgctgccttattggacactttaacatagatccctgtccaaaaaaagcacaaatttcagtagtgtaggtaaacaacttcaacataacatatggagtacagagggagagagagaaaaaacatgagagtctgcaagaaattatcatttgtgttttatagtattttttctcttatagtttacccacatatttatcattttcatagttctttttgcttcttacatgtcttacctttcatccgggaatattttataattcccattggtagcatctgctagtgttaaactgtctttgttgattttgatgataaaatgactttattttacttttattcttgaaagttatttatctgggcattaaactacaggacgggagttttttgttgttgttttccttttttttttttagcacattgtatctattttttgtttccattgtaattgagaagtcaactgtcagtaaatgctatttgtttgaaagtaatctctcctcttttctctgcctcctcttaaaatttttctctttgtactgggttctctttagaatcactatgatatgcctgaaagattttttaatatcatttgatatttttgggttttctgaatgtgtgaattagtgtctttcatcagctatgaaatcttttacacccttacctcttcaaacattacgtctgcttcactttctctcttcttttgctttcggtgtttttatttcttatatgttagaatctctatatgtctccgccatatttgtactgttcaatatattagtccctagccacatgggggtatataaagttaaacttaactaagtaaaattaaataaaatttaacagtcagtttttcaatctcaatagccacatatcaagtacccaacagctgcatgtgtatagtggctactgaattggacagcacagatacagaatgtttttattattgcagaaatttctattgcactgatctatatctgttaggtgttctggtatattttcaatctttcgtttattcttcatttctgatttttcttagatttttgaccaatctttttgttcaatagttctctatcaactcttcctaatttgctgttaatttgatctttttagttattttactttaattctagaatgtatattttgttaattttttaatctatgatatcacattttatggttgctggttccctgccaacattttaaatcttgactttcatctcattgtatatagtgagcacagttgttacatagtctgcctggtaattctattttttggacttcattgtgtttgctcctatactgtattatttttgctgtttttttttttcttatggtatttcaactcttcatgtattcagttatttctgagtatgtgctggacattgtttctaaaaactaactttcagtaataaattcaagacttgattaaagttgtcttccaccaacaaatatattcattgcttttgccagaatcctgggcacactatttttgaccatttaatacaggttcatgctttaggttttctgtagagtagaatgatgcaaaactgtcatcttaactaccagacttcaacccttaaagtttcagtccaaagtgttagtgtcctctcaagatcctcctcccaaatgtacagaagctgctaatgacagaaaagaagaaatatataggaaacatcaaacaatggagaaaagtatcaaaaacaaaagctcattcttcagaattattaataaaacagtcccttgagagactggccaaagaaagagaaggcacaagttgaactataaaaacttgcacaaataagaaataaaagaaattgatttaaaatcttgacatagtcaagaaatacaataaattgataatatattaaaattttataataaaaataacattgaattatgaaataatagaaactacaaaatgccaataattaattaatctataccttttcaccctataaaatagttttataaagggctaactacactttcaaaaaacaaaaattcttattttctaaaaccattgtacataatataaagaaatgtcctttaacaaattttctgaaaataatgtagcctttatatcaaaaaccagaaaaaagacagcataagaaagtatatattagtcaatattaggtagaaacatggatgaaaatatcagttattaacaaaatacttctcatatccatcaaactcacataaattaaatttctagcaactcccagtgccactgaagttatagggtatctggaacattcatctattcccaataggagtttaaacagtacaaccatttttgggagtgatttggaaatatccactagagtaatgcccagtaatagtggaatggattgataacttgtgtgtattaatataatggcatactatatacctgttaccatttatgcacaatttctttttgactcaacatacacacatttcaaaaatgcaaaatcaagtaaataaaccaaggtgccgaagaacattaaaaaattatactatttgtgcaaatttaaaaaacacacaagacacaatacaatatgctgtgtgtgtgtgtgtagatatatagagcatatttatacatcaactgtagaaaggcaattgtctcctgggaaggagactaggaaaggagatcaagaagggatacaatggggacatgaagtctgtctgaaaagaaatatttaaaaatgatttgaagcaaccaaggctcaatataagcattttaatatttaggtagacagtgtttattaggtataatattagaccttactttataaagtaactgtgaggactaagtgaattaatgcatataaaaggcttaaaggacagagtaggtgctcattacatgctgattttcataattgttactcattagagatggtgaatttctagacagaaaagcccagctattatttatcactgtcccttatgcatactacaggatctagcacagaggagatgctcagtaatttggttgaatgtgtccacacatcataaattgctgtcttcatctcaaactccctaatggtccttgcctacttgcatggatgtaggtgaatgaggagtgtaacagattggcataaaccactggtagaaacgttagggcttagtatttgactcttacaaccagttccatatgtgacctggtttatggtttcagggcaagtgattacttttaagtaaccaaccagcagagtttagacgtgtttcgagattcttggaagaaggttgattacataaatgccaactatattagtattgatttctcaaagaataaaaagaaaaaccaaaaaaaaggtcaactcaatcagctatttattatttcttctgttctttaaaattgtaagaatttctgaggggtgggaatttcaaagctatttcaagatcattatataaagcattctttagtatataaggtcttaaggaggagaaatgggctttggctgacttcacccacaagctgaactccataaatattatatagttaacacacgatccagatactttaacttcacagagttcaggaaagaacagcttttgtttatggtgagttttcctatgtgttgaatataaagtaccaattaaagtgtaatcggaatagctgtttgaatttttggcagcgtatcagaaggagttacggaaagcagggccttttcaatgatagatatgattttgcagaggtcatgctatggcctggatagggcatgcctggcctgatttcaaaccataaatgcatgcgaatgtaaggaaatgaatcctattccagggcctatatcttcattgccttagaaatggtttttctatttccaaagcaattctggttttcagaataatttgcctggaactcaatccctatatgctgatgagaccaactgaggtctagaatggctaagacactggggcattttattttgttatttccactgtccaattctttgtagattttgatttggaaaagtattcaacccattggaacctaaaccattctccctctccctaaaatattttcatagaactgagttccccttattttcagagttcttacatcaattatacatgaagtgaatgcctgaaaggatcaggactgattgtggggaagaagtgaagtatgttacggaataaaagactggaaacagaaaataagtagaaaacagaaaaagcaatgaagcaaacatgcatggttgacataaacgtggagcagaaactacaacaataggttcttggatagtgcctctgaatgggacaaatagtcactctggagtctcagtaaaaatctaaagagagaaacctgatccaagttaaaggtatagtcagcgactagctcaacttctaacagcttccaaaaaccaaaaatgtgcagttgaccttgtaactaggattgcatatggcacccagccaaaacccgccagccctctccagggcaaagagtgacagctttgctgtcctgcagttgaaacaagtgggagctcatattaaactgtgccaagcagggcctgccactaagctgaacacctgtaattcacccatctgtgtccctcaagtcctcaccccaaagtaaattgattctgagctctaacagctgtctgggggactctgctgggctgttcccagcaggaaaggatgtgggagatgataaaagctgtaggtgtgtttccaaggtcagaacccaaagagggaagtttttttgattctttcatttgtagagatgacaaaagtggtagtgggtgggatgcataatttccagatcatttaagtaactaccagacgttgtttatcccatcatatgatttgaaaattaagataatcatagttgatgaaagaggagaaagcctgggcaatgagggtccctttcatcaaggagtgtaaagcaaagagtaggagaaatggggtacaaacttagaaaatgaaagtcatatgcagtgtctctgtaaaggtaagagaatttcaggaatattttaaacatacattcagtgtagactaccctgttcatatcaatgatagaaaaatagatatgtaagttttatgagcaacaaattcaagtttggaagaaagaaacatacacatatggtcacctgctatgggtatttataatattagatgtaaagtgtttataacagcagactcttgccaacatcagcagccattgacataaatagattaccgtagattactagaaataaatgaaacccttgtattctatataggtgatattccaaaagtaaacagaatcttaaaggctgaatagcccaggctcccttgtgacttgagccatagccacactttttttttttgcaagcttacatactattttgtttctggaattttttaaatgcttttgagtaaagagccttgtttattgttcagataactgttttatctgctattactaaatagggaatcttcatttattcattaccagtcacacatttattaattttgtttaaaactatttattgtcctggtccttgggatatagtgataagtaagagcattagtctctgcttgcaggctcatactcaacaagtggtgactttcaatgtacttttgtgtttatgcacacatgggaaaactagaagcaatagattgcgtctaaagcaaaatgctaagaaaagagcttctaactgaaggcatctctatgagaagtttgactgaattcagctgatttccataatcacaaacacctactgaataactacctatgctttgtctttggtgagccacaaaagtgctgagattcattcatagggccccattctaaatgggatcagcctagtgggaaaagactctgcagtcctcttagaatgtgccatcaatttttccttcatctgtgtgcaattgagttgtccagcacatacatttaagtgcctataagatattaactacattgctaggcagtgggaataaagagtgctgttagtctctgtccattcatctgcacatctatcctttcacccattcatccaattcagatatttaatgaatgatgatcatgtactaagtgtttatgctagactgtggagaaaaaataaaacaacatagacacactttatgacctcatggagcttacattacagaagcagacataaacaaaacataagaaaaacaactagatatacatgaaattgacaaattctggtatttggagagatttctatttttagaactataaatctcaagaagttctgagagaccctcctgctataaaatgaacagtctatgaaggcaaatattttagagaaaatgctgattccacaattattaggaaagatgccagaggcaccccccagtttccctcccctacacacagacacagacacacacacacacacacacacacacacacacacacacacacacagcaaacaaacaagaaataaaggaaccaacaacaaatatgagttggtcctagaacagctttgaaatgaggaatctaaaggtaccagaatcagaatgctgggggttgatattgccgaggctgggcagctggatttaaaaatattttataacttttcgtaatttttctctacatggcctagtaaagagaagaatgccctgggcattctgttgataccccacaaggacgactactcaagaattagggtttgagatgattcagctcttacaaagactgatcttcgtgaatggactgtttgctctctgcttggattaaggtgatttttccctaacctaaatgcctaccaggtacacaattagatcttctctagaagaatataaagccatgcagagccttaattattacactttttcaaactcaatatccattatttaataaaatataattactgggcatatagggatagaaggacaaataactaatgatcaagacagagagagagaaagaaagagactagaagcagaccaataggagagccaaatattggaattaatagataacaaatttaaaaatgattatgatcaataaatacaggaaattaattggtaagattgatgcacaaaatacacataggacatggtgaaaatgtcagacactcttgaatccagttggagttccagaaaaggaggagatgcaacacatgacaaagcagtaagaaaaaaaaaacaaacaaaaaacactctcaacaaacacacaaacacacacacattttaaagtgtacattgaatacttaccaaaatagattataaaatctttctcaattttttaaaaattgagatcttagagcacgttctttagccacaataaaattaaactaaaaatcaataacagaaagctttccagaaaatactcaaatatgtttttccatttgtttgtgtcctctcttatttccttgagcagtgttttgcagtcctccttgaacaggtccttcacatcccttgtaagctgcattcctaggtattttattctctttgtagcaattgtgaatgggagttcattcatgatttggctctctgcttgtctattattggtgtataggaatacttgtgatttttgcacactgattctgtatcctgagactttgctgaagtttcttatcagcttaaggagatttttggttgagatgatagggttttctaaatacaaaatcatgtcatcttcaaacagaaaatttgacttcctatttgtatagcctgtatttctttctcttgcctgattgtctcgcccagaacttccaatactatgttgaataggagtgatgagagagagcatcctgtcttatgacggttttcaaagggagtgcttccagcttttgcctattcagtatatgatattggctaaaatattacatcctcatggataggaagaatcaatatggtgaaaatggccatactgcctaaagtaatttatagattcaacgctattcccatcaaactaccactgacattcttcacagaattagaaaatactgctttaaatttcatatggaatgaaaaaagagccaatatagccaagacaatcctaagcaaaaagaacaaagctggaggcatcatgctacctgactttaaactacactgcaaggctacagtaaccaaaacagcatgatactggtatcaaaacagatatatagaccaaggaaacagaacagagacctcagaaataacaccacacatctacaaccatctgatctttgacaaacctgacaaaaacaaggaatggggaaagaattccctatttaatcaatggtactgggaaaactggctagccatatgcagaaaactgaaactggagggcttccttacaccttttacaaaaattaacccaagatggattaaagacttaaatgtaaaacccaaaaccatacaaaccctagaagaaaacctaggcaataccattcaggacataggcatgggcaaagactacatgacaaaaacaccaaaagcaattgcaacaaaagccaaaattgacaaatgggatctaattaaagagcttctgcacagcaaaataaactagcatcagagtgaacaggcagcctacagaatgggagaaaatgtttgcaatctacccgtctaacaaaggtctaatatccagaatctacaaggaacttacacaaatttataagaaaaaaaacaaacaatcccatttaaaagtgggcagaaggtatggacagacacttctcaaaagaagacatttattcagtcgatgaacatgaaaaaagctcaacataacggatcatttgagcaatgcaaatcaaaaccacagtgagatacaatctcaagccagtcagaatggtgattattaaaaagtcaagaaacaatagatgctggtgaggctgtggagaaataggaaaacacctttacacttttggtgggaatagaaattagtccaaccattgtggaagacagtgtggcaagtcctcaatgatcaagaaccagaaataccatttgacccagcaattccattaatgggtgtatatccaaaggaatataaattattctactataaagacacatgtacatgtatgtttactgcagcattatttacaatagcaaagacatcaaatgacaatcagagatagtctggataaagataatgtgatatatatatatatatatatatatatatatatcatggaatactgtgaatatttggaatataaattattctactataaagacacatgtacatatatgtttattgcagcactatttacaatagcaaagacccaaatgcccatcaatgatagactggataaagataatgtggtacatatacaccatggaatactacacagccataaaaaagaatgagatcatgtcctttgcaaggagatggatgaagccggaagccatcatcttcagcaaactaacacagaaacagaaaaccaaacattacatgttctcactcataagtgggagttgaacagtgagaacacacaggataaaacaaggaagattaaaatatattttaaactgaataataacaaagacacatcatttcaaatgctcacagaacatccaccaatatagattatatattatatataatgagttcataacaattctcagtaagtttaaaatatttgaaattttacatagtatgttctctaacacaacagtattaaaaaattaatagcacagagatttctgaaaaaatcactaaatatttgaaatgtaaatattatacttctaaatacatggttcaagtaaaaagcagcataaaacataacatatattttgaattaaatgatactgaaaacacagaatgacaaaatttgtgggatgtaactaaatctgtactagagggaaattcatagcttcaacttcttatactagcaaagaaaaaaaaggattttaatttcagtgatctggttaagtgttaagaaacatctagaggttacaacactcttcatggtgaaatataagggcatacccctctaaccacctacatgcaacgtaatcctggagagcctatccatgagactccacatagaaaactctaaaaaaatttttttaaatactaaaacctacaagtgaatttagtgacattgtaggatacaaagtcaatacacacaaatcaatagtattttacataatagctgaggacacatggaaacaaaatttaagaccacaccagtcacaatagcttcaagaagaatgtaatattgagaagaaaattgacaaaatatgtgcaaaccctatatactgaaaaacactaaataaatcttggtggatattaaggctaaatttttttagatgccagttttactcaagttgatctagagattcaacacaatcccattcaaaatctccacatggctattttacagatatttaaaattttattttttaatttatatggaaagttaaagaatagccaaagcactgttgtaaaagaataacaaagttggagagctacttaatacattatttgatttctagatttactataaaaatagttatcaagatggcatgatattgatgtaagcatagatatgtaaatcaatagaagaatagtgagcccagaaatatattaacacatgtgagctaaacagatttttgacaatgataccaaggtgatttaatgggggaaatgatagttgttcaaaaaatggtgctgaaataacatccacatgaaaataaatctcaaattttacttcatcctctgtgtaaaatcactcaaaatggatcatatacctatataaaacctaaaactacaaaagttttaaaagagaatacaagataaaatctttaagtacttgaatttggcaaaaatttctttgatagaaaatggtttacgctaactataaaagaaaataaaatgataaactggacttataaaaattagacttcttttcagaaagtgccattgaaagataatgaaaaggcaaaggtacagactggaagaaaatgtctgtaacatatatatctgagaaagacagagtgaggagtacaaaaaattaactggggaggagagacatgctagagaacaagaatttgctgaacactttttatgtatctgatactgtacttaactttgtttttaaagataaactattggagcttagagaagctttcccaaagtgtgacaactaaggtattcagtctttccttccattctttaacagatgagtctcccttggtcttactaaaatattactaataagggaacaagttggtcctttagtgtttttttaaggaagactagaggataggaagctgggcatggctacatgtgagatcacgaagacacttatagaaatccttttccttcttattctgtccctgaaaccatatgcatttatagtggtttttattcttcctgatttattttgaggtctaccctaagctgtaagccctaggataagtctattcaatctataaaatctaactagagttggtaattttttttttttgagaccaagtatcactctatcgcccaggctggagtgcagcaacgtgatctcggttcactgcaacctctgcctctggggttcaaatgattctcctgcctcagcctcctgagtagctgggattacagtgcctggcaccactcctgactaacttttgtatttttagtagagacaggttttagccatgttggccaggctgtacagccaataatttaatactagataatgtttaaccactatatttgaattttaccattaatttccacttttcccttttaaatctaaggtgtgactccataacaatagatttcagtcttgtctttcatccttgctactggaagtgtgaaccatggcccaatagcattggcatcacctgggagcttattagaaatgggaaagtcaggacccaccctacacctacttcatcagaatcttcagtttaattaggtctcagcttattcaaatacacattaaaatttgggaaccctgctgtttatgaccacatagaaaaacaggaaacaggattgcttcctgctcctgtaactacaaaggtatgaaagcacatccttgggatgtctagactatagtctaccactctactggactttactgcttgcggaccatgtagaaaactttagacaggtcgtttagcatctctcagtctcaatttcctaactataaacaggatgagtacattgtcttcatagacttgctgtgaggattaaatgagataacattcataaaatacccaaggcaaatgctgacacggtgttggttttcaatatatgcagtcttttcaagtggtcaataaagaatgattctattttgcatgaaataaataacaaaagtcagtgccttaaagccaatgcaaacccttgacatttcctcacatcaaggagcaggatcatttgcctctttctctatgtgttatttttttctttgtgcaatggtctcagtctatgagtgggggcaggcagtgctaggaagagccattgccttttagattgtgacctccccccatccatgtccccaaacggcctacttaataacaagagcagtaacggggttcattatgcatgcagctctgcaatcattgctgaggagaaaattagtttgatgccctgagcgacagttgaactctagaaagtgcctaaataaaataaaagacaaggaaaatatatacatacacataaatataataaagagtgcagtgagaaaagttatgaagaggccaatttcaaaacttgcccttttcctggtgcttcttgattttttaggaatggtgtgttggttactaaaaagtctgtttatttaaccaaaagttgccttgtctctagcattgtgcaggtccatgggaggtctgggaggctcaagcatgtacacacatgcatatcttaaaacaacacagatgaatctggaagccatcatcctcagcaaactaacacaggaacagaaaacaaaacacctcatgttctcactcataagtgggagttgaacaatgagaacacatggacacagggaggggaacaacacacaccaaggccagtagggggatgggggctgatgggaggaagagcattagggcaaacagccaatgcatgcgaggctttaaacctagatgatgggttgataagtgcagcaaaccaccatggctcacctatgcctacataacaaacctacacgttctgcacttgtataccggaattaaataataataatcatcatcataatcgtaggttgccttctatgaattgttaaaaaaaagattgttttgccattatttttggtttacagaagagttgcaaaggaagtgtagtgttgtcatacagccttcacctagcttctaatgttaacatcttctataaccacagtaaatttatcaaaactaagacattaacattcatgtacactattaactaagtgtaataggcattctttggatctcccctctttggtttttctggacctggatctaatccaagacatattgcatttagtaatgtatgcttagtcttctccagtctagaagagtttctgtctttccttgaatttcatgaccttaatgcttttgaaaagtaccagtctgatattttgtataatgtccttaattttgagtttatctgatgttttctcatgaacagactgaggttattaatttgggggaatgaataccacagaggtcatgtacccttctgatatagtttggatgtgagtccctgcccaaatcttgtattagaatataatccccagtgttggaggtggggcctggtggaagtgaccggatcataggggcagatttctcatgagtgatttagcaccagcccccttggtattgtcctaggaggacatgagtgacttatcctgagatctggtcatttaaaaatgtgtaacacctctccttctctctcttgctcctgctctggccatgtgatatgcctgctccccctttgccttccactatgattgcgttccttgaggcctccccagaagctgagcagatgccagaatcatgcttcctgtacaacttgcagaactatgagccaattaaatctcttctctttataaattatccagtctcatgtatttccttatagcaatgtgagaatggcctaatacatcatctcatcacatcttatcagtggcacgtgatattaaaatgtcttattactggtgatattaactttgattatgtagttaatgaatgtctccaaattcccttctgtaaagttattatttccccctttctctaccctgttattaatatttataagaaggttactaagtctagttcacagttaaagggaggggaagggagatgggaggtgtagtgagacacaagacctcttataaagacaagatgcatgtttcagaaatcattagctcaccaagaggccatgacaggatggacttctattcaggagtaaaagaaaataagtcatagagttgataaacacatgatttggtgagggcttccatttaggcaaagttgttgcccttcaatgattgtgacttttttctcctttcttctaagattttttgtgattgttttaaccttctggtgaattatcatggtgatagcagcatttttgccttgtgcaatgctttaaatggtataatgtacacacacacacacacacacacacacattcgtatatataatccctcctatctttttttcctagtttttccttttgctttgaaaaccatacacttctccagcatactgttactactacttaaaaagtatcttagccatttctttttttaacttttaacttttaaattcaggggtacaagctcaggatttttacttaggtaaacatgtcatgggggtttgttgtacagattatttcatcacccaggtattaaccctagtacccattagttgtttgtttcccaatcctctccctcctcccatcctccaccctctgaaaggtcccagtgtgtgttgttcccctctgtgtgtccatgtgttctcatcatttagctcgcacttataaatgacaacatgcagtatttggttttctgttcctgcgttagtttgctaaggataatggccattatcttagccatttgaaaataatgatttaacctctctcaccttcattgtcattttagaagaaactaccatttggtgtcctgctgagacaaggtatgtagttcgcttttatttttctttctttatgtacatgtagaaacaaacatacagttctaagttttgaaaattaaaggtttagggacatatttgtgttactttaacattaattttatattacatatctttgcaaaatgctgaaatttgcacttattttagccaggtagaaaaaaataggaatggatttttaaaaactgtttttggtgctttactgaaagttgttttccccctttcacctttatttgatatgaattttgtcccttaaccaaaaggaagcacatttttcaaattttcttctcttcccatactttggctccttgcaaccaagaacagcataattttctatatttttttattttacaaagaattatcttttcctttagggtaaagcaactgctttcattcattaaaaagaaaagcaaaaataaataaaacacatttttaaaaagcaaacaaaaaagtacacagcttattcttgtaaaaactttatcgacatggctattttctcttctagcgtttcaggttttagattaaaagcctcagattagacaaatttttgttcctcccaagatgccaacatatttgtatttatatattttaaaaattcttgtaagttttattattttctgccaaaatgattttagcatttaaaaatccttatcattaaaaaggtaaagaatatagaccattaattctattatttttatgtacttctcagtaaatctctgcaatttaccaatacagtttctcccccatattatggaaatgtctcttattacgaatgtggttattgtctttcttttcattttcctaatctttccaagactctttcctcaggagaacctattatttctattttaggtctctattctttgttcattctaaaattttctttcttgccatttttatctcattgttctcctactttttattctcagatgttttctcaaaatatcctcctcgctactgattcaacatccctacaatctcaattatactcttctctgtgctcgatgtgaatattgctgggattttaaaaatgttcactaatccttaattcagtttatctctaaaaatgtgtgtgtgggtgagtgtagggaaatgtagggaaaagaaataattaaggaacacacactgtctccttaattatttcttttctctacatttaagggtcatatctttctacatatttgagtataatagtttcttaaaattttcttttgaatactgcaattactgacagtagcttactttttttgagatttctgaaacttatctttcctatctattgagccttgtaagttctctttacacgtatgtttatgtctatatctacttgtctatctgtgtatctatctttgtagagagaaagacttggacaagttacttgcaaggaagttattggacagttttttttgtgaaatattgtctattttcatctttgaaaatgtgataactgatattatatatatgaactttaaaaaattaatataggcattaaaatggtttcacattcattattggaatttctttaataaattgcctgttgatgtattttcctattttttctcttgaggcattcataattttatagttaattttcaaaccttctttgcttaccaagaatattaatactttttctggaaaatgcctagcaaagactttttgtccatttaaaaatgttccactgtttcctgttatttatgacttaatgacatttcagaactttaatacactaatatccataaatctcttcctttttccttagaaaatattttcacaactcaagacaagttaaatatccacttatgggaacagtgctgaaggcctggactaggatggtagcaatggagacagactaaaggtcagcataacagtcaacattaagggggttgaatcaacagcacatagtacctgattggaaatacagagtaaattacagtgagaagtgagttgctgtccagatttctatcttggatatgtagacagatgatggtcagcaagcaagaaaacaggcagaacaattttagaaactaagaaaatgtatttccaatggaactaattaaatcagagtctgtaaatagcattgtaagatataggaggctgatatggtttggatttgtgtccctgcctaaatctcatgtcaaattatatctccaatgttggagaagaggcctagtggggggtaattggatcatggagctggattttccctttgctgttctcatgacagtgggttctcatgagatctggttgtttaaaagtgtgtagcacctcccccttctgtcttttcctcctgctctgaccatgcaagatgtgactgcttctcctttcaccatgattgaaagtttcctgaggcgcccccagccatgctttctgtacagcccatggaactgtcagccaattaaacctctttttaaaataaattaccctgtttcagatatttatcagtgcatgaacggactaatacagaggcagaagcacatctgcaggcagaaatggggaaaaaaataatatcagaagaaaggataagaggaagagcttaagaataagtatgtgcaaattttagttgatgctggactggggagaggtgctaatggattcagatcctgggggaatctggacaaggatatggtccagagatcaatgggaggagaagaaaattaataaacttgacttaaggactagcctctaagttgagaaatgtaatgtttatgctaatatttttacagaaaaaggtgttatcattctcagttttgcaacctgattcagagaagctaagccatagaccccaagccacatggactacatggtggcatctatttaaattcatatttatttgttcttagcacttttgttgtggtcgctatgctacctctaagtaggactttgacttcctacaaaattcactgttacacatccaggtagatgtgaatacatgctgcagtaatgtctgtcacccatagtcactgcaggggaagttggcatcacagcactgacgatatgcctactatctttaggttaaagtggatacgttatcattaccctatgcaaaagaatctgatcattgccctgaagataattttgttatctcacattgcatatgtgatcattaccctgagggcagagatgcaatcattggcctataggaatacttatcattatggcttggcaagtggaaaagtgataattaacttgcacgaatagatgggatcattgcactacagatagatctgttattgcatttcctgaagaaatgcaatctctagtgtgcaaaagacaatgtgttatctacatttatggtagagatatgctccttatattgcccataatgatgatatcaattgcatttcaggtggaaattaggattgttgcattgctgataaccttgttataattacgttacagaaagagatgcaatcattcccttgcatatggtccgtatgaagacgggatcattacaggaaaggtgaaggagatacagtcattatgctctatatacacccatttttatggctagcggctgaagatgggatgctttctttgctggaagacctattacctgttaggttgcaaaagatgtgatcatcttcctaaacaataatttagagtcccataacaattttaagtgtgctgttcatgaaaatttgaatacattgtattgggaatataatggaagtgagatgcctcatgtcgtgagaaaatctgacataaactccttaagcatgagaggccatgtgggtatggaagccctgaaagggaggaaaaaacagccagaccctagctgttccagtcatcccaactgaggtgccagacttgtgattgaggccatcttgcatcatctaggcctagtagagctgccaactgactgcagacacatgagtcaatccagctaatgccacatggagcagagacaagccgcccagctgagcccagtccagatgacagaatcatgagcaaataaggttgttgttcttttaagccactaaattttcgggtgatttgttacacagtaataaataactgaaacaactatgtacagtttaatgatctgaaatcaatccatagtgttatgatagcctttttaacaaaattgaaatgataacttattcatttacaatgcaaatcaatttaatggcaatagttacaactgccctgaaatgatctaaagcctcatgaagttgatttaatatctagctacccaacatacttaatcacatgttcacagttgatgaatagtgactgaatctccatgagcaagataatagtaaagctctttttttctctttctctttttttccagatgaataattttacatttacactgataaaaagttaaagttgcagctctgttttcacactacctgagggatctttgtagattacataaaccctaagcctcctgtgtaagttaaggaaaaaaattccaaactcacagtgttatcgagaggattaaataacataatttatgcaaagtcttaaccatagttgctagcatttaaactttaacttttgtccatgtctctaatgtaatttaaaatgatcttactctttaaggtttgatctaatagaatatttgtcagacacaaagaccaagatttgtcccagttgatgaaccctgggtataactcaatagcatattggcagtttttattttctgttaagtctggatccattcaattagtgatttatttcttaatttgtcaaacattacattaacaaagtaacaacttttctatccatattatattgtggttacaaaaaatggatcaattatatttgaattaaaaaatttaattgccaccaaagaagagaaaaataactagagaaaaataaaagagatgtgtcaagaaggaataaagaggctgataacatgagatctcttctagctttgaaacatgtcttgtgaaatgactaaaattttaaaagctaggatcaagtattggtgaggagatgaagtaattctaagtctcatccattgctaatggggtatacattggtttaaccagtttggaggactgtttggtaatgtccaaatatttattaaagttaaacctactcctaagtcttatagcccagaaatttcaaacctaggtaaatacctaagagaaataagagtacatgtcttccaaaagatctatacaagaatgtgtatagcagccatagtcataactccctaaaactggaaatgacccaaatgtccataaaaagggaaatggatacatgtatcattacatatttatctaatgaattgctatgtcgctgtaagaatgagcaacccactgatacatgccacagtatcatgaatcacatagacagtatgctgcctgaaataagccaaaataaaaaatgtcttatttcacttatatgaagttctagaatatgtaaacgtgatttatgatgacagaaattaaaatagcagttccctttgcatagggggagcgtattcattacggaagtgtatgataaaacattgtacattggtggaatgttctatatcttcacttgagtgtttaccaggatatatgtccacaaaaaagttaggaatccatacttaagatttgtgccctttataatatgtgtgttatacagccactgaaaataaattgatagataaaaagtaatgtcttctaggttccatatggagaggactgatgaagccagcattaggcgtgatggggacgtgcataaatgtgtatgttatccactgagacacagattctgaagcaccagaacattaaaggcacttctacttgtttcttctacccagctgaaaggacagaaagcttcttccacagagccaggacagtccaggggaacgtagtccttcgactgaaagctatgcttcctattttctaacaaagaggctaggtcatgttgaccacccagttttggcctgcctggcttgctttttattccagcctggaggactttcagggttgaatatccactcaagccaaatcccaagaagcataacctgctattagactcttgtcacttatcgggtgaggggctgtgcggctgttccagtgcttccccacttgggtcttgtgacataccctggggccaagccaagccctggaggttagcttctacagtctgtccttaaagagagctcagggatgtctggacaggacctggagacagtgccctgggccagagacctctgatctctaggccagcagagtcaccatgcagacagatttatgagccttaggcaaaacagctggcattcctgtggccatctttctaccccttcctttccacatgaccatatccttggccagatcttcatgtccttagatggctgttgcctttgggtaaattggcaattaagataaatgagcatatttatcatggccttgtggttacccctcctgaagctctcagggtggcaagctgcctgaccctcctactatgaacttagtaactttaaaacagagagtatcttttcttgcccagctgaaatttcctccccaggcgacctacttttaggattaatatgcgggaaagtctgcagttttgttttcagtgagggtagttgtgttttcaaggaaagaggtagcgccttacagtcagattagccagctttatttctttcatcaaccctttactggctttctaaattttttcaagtaacttcacctctctgagtttcatttacctcattaccttcatcaggtaagatgacatatgaaaagcccttctcaagcaactgcaaagttccaattaatagaagaaattgtaatgactatctgtgtttgaagcggggccatttttcttatttggaattttcacgtattaaaaatatggatcctttacacctgtatgcctttactctccaaattgattcattctctagttcctctatctcattactaagttcaaataatcatcttcctacaaatcactcagtttagatgccttgaaggcttctttgaatacttgctcctgttcacacccgacagtcagtcatcaagccctgtggaacttgtccctggtcaacatccgttcttctccattcctactgccgttcaccacacgcaggccctcattgtcccctcctgggatctatatcctctcctcagcacctttttcttctctattgataccatagacaacttctcatctcatattctctaaactcaactttcaggatatcatactcttattccatagatcagaactttcaatgactttctccttctttacagctcttcataacaactctgaagatagattcagtccttctttttggaattgcctcttatttctttttctttttatgcccatcataaacctcccattggcaaaattaccatgaacattttcttgtgaattcattgccttggttcattggttcatggacgggcaccaccatgagccaattagaatctttccctgagaatctagaatcatggttaagaaggtatagatctgcctgatgctttgttgaatgaagaaaatataatgtcccaagggtggcagccatttttctgccctatgaacttcaaaatgcagaaaatctatctggaatgtgaaagaagaaggatatcaatgtaaaaacaagaacaatatagataagtagagagagaagagagagtgactccccattctgcttttttctgaggccttaatttttttttatttgtcattggtctgctaagataagttatcccccccgcttttttttttttaggagacgactcactctgttgccaggctggaatgcaatgccacaatctcggctcaccacaatctccacttccagggtttaagcgattcccttgcttcagcctcctgagtagctgggactgcaggcatgcaccaccatgtccagctaattttttgtatttttagtagagatggagtttcaccatgttggccaggatggtctccatctcttgacctcgtgatcttcctgcctcagcctcccaaagtgctgggattacaggtgtgagccaccatgcctgggcaccctttttaatttaacaacctggagttagatttctatatttgtgacactgggagtcctacttgttttaggacctacataccaactgtcatttactgaaatgatatttagccatacattttttcccatctgattataaaacaaaaatcacaaatctagagaagtttgctccaatattctaaaatgcttggaacatacataataatataattgaaactcccttccctcttggcttttctgaccttgaactctcctcttttctgactcctcagcccagcaccaccccttcctttcccttctttgcctctcctttttctactcatcttccaaaagtaagtaatgttctgcaaactgaccttggacttattctcttgtctatttgcaagttctcccttagtgtctcatcatttcctggcttcaactattattttcaggtaaccatctcctcatctttacatcctaacttcttttactgccccattctaacactaccaactcttcgctagacatacccacttggattctcctcctgcttctcaatctgaaaatgcctaaatcagtggttttcaactgggggtgattttgttccccagggacatttgacaattctggagacattttcttattatcacaactggggttggagatcctcctagcatccagtgagtagaggccagtgatgttgctaaccatcgtaaaagaacagaagagcctcttacaacaaagaattatctggccaacagttctgaagctgagaagctctgctctgaaacaaatctcaccatgccctccctgtatttcctctatggcctaaatctgatcattttcctgtgtcctcttgcctgttagtgacaccttcaacctctaaatcacccagaccataaatttcagtaggtcttgttcaactatttgtcaaggatgatttataaagtatgcttacagtgggaaaaaaataaagtaaatattacttctaaaatactttctatatctaggagtgtttgattgtatcaatcttaaatataaatattataaaattagacaagaatacatttaaacatataagaaaataaaacatttaatttcaaataccttatctatcaaatagattctggttaaagcaactaatcttctactctttagaaaaacaaacttattgggaccactcatatattgctgcaattttcctgcacattaaattaaggggagcatggtacaacttctgatgaggatggcaagcctgtctagtactctaacattggaatatgggctttataagcttcttatatgtgttttgaaagggcaacccaaagaaaatgcaaagaaaaaggggatggtcaacagataaagtttttatcaatttctctggggaagaaagtagcttcctatgaagctaattccctgcatagcatttattcctgtctgatgtttgtttattgttaatttacctgtttgttttttgttgctttccactagaatgcaagacccacgaattcaggggacttatatactttgttagctgttacatctccagatttaaacctatgctttttattaggcattctatttgttgaccaaaggaatggattaatgaatacatgcttgaataagtatgtgacttatatgaggtccagtgagtgtccacatgacaagagcttctgctcagggtccagatctatctaaagatagtggaaagggcatgggacttgactcaataattcatctaaagctgttacttttacagttagatgtttcagaattcaaatttcaggttttccctgttaggtatgtgactttgagagaattatttatcattcattcatttatttaggcagtagtcattgcttgagttcctaatttatgccaggtcctaggctagactctggaaattagtggcagagatggccaacagaaacctgtcctcaaggaactccctactaattggagagacagccattaaatgtattcataagggaatgcattgctttgaaggggagaaatcacaggatagtatgggattacatataggggatatgggaggagctacgtatgtctggtgggttttctgtatctatgcttattaatctataaaataaaggtcatacaaacttcctcagtggtgtttttgtaaagataaactatgaaatgatctggagcccatattggttgcaggaaagcgacttagtaaatattggatccattctttcttattcccgctgagcacaggagcagctttgggaactgcaacctggggctggtgcgacccaagcacatagcaatgaaactcatctaggccttttcttccttctagaatagtgacaacagatgtgagaagcctaatcagctgattgctccataaaatcataagggctgcaggtctgctccacatggttgaatcgaaggcttctcaattctgccactttcattttttggtccctcttcctgaaattacttaagttttctactcttacctgaaatgctcacagttgggtgtgatgagtccttgtatatgcaatctatctggctttctagaggtcatagaggtcatagcaggctctagattattcctttagtcacatcttcttgacctggcaagctaaggattagctcgtgagccctctttaagaggaggggctcatctgggttcaccgagattgcaggaggcaaagtgctgtagggcaccacctcattctagtgctacgcattgtaactggctgacctctcagagaccacactgcggccgtggaaatctgccttttgtaagatgccctgagaaactggagaatattagagaggaatgaatataaaagcagtaaacacaacaagcctttgttgaacttagtaattgccatcactgggttagatgagcaaggagaaggtttatgaagctgtgtaggcatggttttaatcatatgaggccagatcgattaggcctggcatctcagtctgaacagatgaaagggggtgtgataaaacccacatttgtaggaggtacctcattgggatggtcaaatctttcttacgtgccctatgaacatgggcaagttacttaccccctctacatctcagcttccttacttgtgaaataaagatggtaatagctatcacgtagggaacagagatcacgtgccaacactgtgcctagaacctcacctgcatcagcatgtatcacactcctaatcatcctgtgaggtaggcagattaggtgtctatgttttacagataagcaaattgagtgtctaaatggctaaataactcttccaaagttacacaaacggtaaactgaagagttaggataggagtctggctaatataatgccaaatccattctataaattactgaatcataatgatcttatagagtccatgtgatgatttaatgagatgttaaatgtaaatagctgctcagaagtaatttttagctgctattgttgtggttattttcattagcatcaccatcacaatcagataattgtggaaagtttcttacttagattcagaagtacagattatacaacagcattaagtgtagaataaaggaaaggagatcctattcatcagcaaggatgtagcgaaggaaagtttaaaatattgactgtacaaggtccaacttctctgatgggcttgggcccacaattcacctaagctgagattttttcatgataggaagctgctgctaattatttgcatacagtgcagcacaagaacctgcccctgaagtcatgtcactctagtatttagcagcttctttatgggaaagatattttatattaataccttgggaaaagtagttacagcacatctctcagagataaaataccaaagcaacactcacttccatcttgcataagttattgcaacaatgatgctgtgtaacaaacaaacacaaaacacaatggcataccacaataagtgtttattgttcatgtgtctgaagtgatcagctaaataaatctggcattcttggatttatgcgtctgaggattggttgtctgcctatctaggctagcctcctttgagatatctggaatggcttgggtctgtgtctcatccttctcctggaactagcaggctagtctaggcagatccttgctgatgacaaaggctcaagaaagcaagcaggcatgtgtaagaccacttgaggaagtagaaatccaacagttctacttccttcacttagctaaaggaagttacatgggcaaacccaaaagcaagagatagagttgacctgttgactttaaggaactttggtgaaaggaactgcaaagtcatacagaaaaaaagagtggttataggaataagtgaaaaatcaaataatgtcattatctgcccatatcttttcttaaaaacggaatccatatgtgtttgaattttattaaaggagccccacccatatcattagtctagttttatctccaagataaatatataacacattcagcaaatgggttgaagtcagggtcaggtttgttcctgtttattgtctcacccaagatgagcaccaaggagttcagttgttctcacatgtctgtgtgttgctgggccttgtttctttaacaattaattcgttatgagaacagagcttaatccaccctctttactctcacaatgtgtgtgtgggtgtggatgtgggtgggtgtgcgtgtgttaactagcctgtgaaagactgactttttcctagagtcatcagccttgagggtgactctgagaggtcctcggtttatactggaggtagtagagtgaagtggttgattatacaggctcggaaatgaaaccagccaggattcaaatctcaactcttatgtcttaaatatgagatatgtacttagttactgtaatttcatggattttaagcttctttataaaaagagtaaaacttctaattcagagagatgttgtaggactaaacaagatattatgttttgaaagccttttgcagtgtttgcaaaacatatagtaaactgtcttgttcggtcttgttaataccgaatattttaaagcatatgattttaataataaatgagtgttattggttatggtctcattatcatcatccattcatccaaccatccatttcctcgtagatgatctacaggagtcctaatcatttctaagtcacattacacaagatttccttggtcaggaaaaggttttcacttaggacagaccattatctcctttattctctttcctctgaaattgccatgagaagaaaatgccacgaagaaccatgaaaggcttccctcttgtctctgtttctgcaagcactgagaatacatgcttctgagcatcctcataaaacactttataaaaacattcatagatttacagatagaaaataattcaccctggcctcctgaaaactaggtgtcaattactctacactttctccattggatccaaacctcagaaaaattgttgttttaccattttatttgctaaaagtagtgactaaacgaaaaagaaacataggagaatatatttgtgcatttgggttatgcaatagtttcttagatataacaccaaaaagtatgattcataaaattaaaaacataaaaaattggacttcatcaaaatgaaaacattttgctcttctaagaacactattaaaatgaaaatgcaagtcaaagactgggacaaaatatgtgtatatcatgtatctgttaaaggacttgtatccagaacacataaggaactcttacaattcaaaaagaagaaaacaacccaaatttaaaataaccaaaacatttaaatggacattttgccaaacaaaggtacacatggttaataaccacatgaaaacctgcacaacattattagcaattaggaaaataccactccatactcattagaaaagttataatccaaaagactgacaataacaaacatcggtgaagacatagagaagctagaactctcatatatttctagtggaaatgtaaaatgatatagtcatgttggaggaaagagagagaaccctaaatcctaaccaatagacaccatgtaagatatgatacagccattttggaaaacagtttgataattgcttaagaagctaaaattattcttaccttacaaaccagtaattccacttctaggtatacaccccagaaatatgaaaacatgttcacatatagacttgtaagcaacattcaaagcaacatcattcataatagccaaaatgtgagaaaaaatgcaaatgctcatcaaccagtcaacagataaagtgtgatccatacaatggaatactactcagcaataaaaaggacagattattgatacataccacattttgagttagccttatttcactgtgctatgtgaaagaaaccagacataaaaattgcatagtgtaaggttgcatttataagaaattcctagaaaagagaaatctatatgtagaaaaaaacagattagcgattgttggagactggggattagaatggggattgatgacaaataggcacatgtagagtttttaaatgatagaaatgtcctaaaaattggagtgagggatggttgtacaaacgtatacattaatttaaaaacactgaacacaaaattggtggtttttatggtatgtaaattataccttaatgaagcagttttttttttttaaagttaaatgagatctagaactctagtcaggactgtgttaaaactgctaacgttggagttgttttcttcccaaaacaattcaaataatgctgctcgttcctattaggcaatacatatttcatttctagtcagcatgtggtgaggtgatcaccttattattttctttccttctgcatactccagatgcacttttgacttaatatcttcgttgtatcctcttaattaggttcttgctgtttccttgagaccataccttcagtagttcatgcctagtttaaattttatcctccactcagatttaattcaaaccaccacattttaaatgccttatagtttatttctgtgaatgtaagaaacacatccttggcttgcttttacaaattcattactgaagagatggactagaggggccaacgattgattccaagagacaccaattgctctattcccctgcctgataatgagcccatacccagagggaatcggccagtgttaaatctcataatgacaaacagaaatgtgcagcgtcgttatcactaagccaacaccattaaaggccagtgtttattgacacttcaggtgactggatgatgcctctccaggccgagctaatgaggagaacctctccattacctcttatcgagatttagcagactccatagctacccaatgaaagtggaaattactgggcaagcactgacatttaccagagactggccttcagtcataatgcataaggcactcaaggacagatttgtagactcagaaatccagtttatagaggcttttgttttagcctgttgtttgcaaagcctgcaccctcaaacatttttgctgctctccacagtctagtgcaaaagtggttgttttcatggatgtatttcctgccacttgtcttaagcacgaaaaaaagaccaaagcacaaatttgaaagtctttttggttcttgtattctttagaagcccaccatagttgttgttttctgatgggatttattcactcaatcccaatcattcatagaccatctccataaatttgcactttccatctactaccaaattacttgcactttcaagtaattaattaattattttcttaaaccaattcatattttttaaaaaatatttttcagaaaggaaatgtaatcttactaccattaataaaagataagattaaaaatatatttaaataaacacgtaactattaattgctgtttccctaaccaatatactttctaacctaatatattaacagaaccatgttttgctttgtttcgttttgctttgcttgtttccagagtagcaatgtgaacagatataaactacattttccaacctcctttgcagttaggatggccatggatatggtcctgggtgacaagaataaaaagatgatgctcaaaagagattctgggaaaaccataagaggagggtgaggcaactgacatatacctttgcctgtcctcttttttcctgccctgaaaatggtcacagtgttaaagatgaagtggcaattttgggtcaatgaggcaacaagcatgaggttgaaagtcacactcaggtcagaggaatttcaagatatctactgtacaacatggcacctatagttaataacatgctttattcttgatgattgtcaagagagtagattttgagtgctctcaccacataaaaagataagtatgtgaagtaatttatgtttatttgctcaatttgggcattccaaaatgtataaaaatatttcaagagaccatgttttacatgataaatatgtatatatttttttatttgtcaatagaattgttttaaaagatggccaaacagaaatatagtcagaatagggtcttcgattattgtgcaagaaaaaaatgaactctccacttgtttaagcaacttctaaatcaggttttctgttactagaggccagtgtagttctcactgagacatttatctctgtcctacttaaaatcacttcatgtgccaccatcagcatgggcatcacactttgatcaacattctgctcattgaatatggtatgtgtagattgtctttcctgaagatagagatcattttttattttttactcactcccatcaggccagaggtaaatttaggaaggcccaaagtggtctctttcccatctaaatatatatatatattgtgggtgggcagcctctgtattcttcctctaattgaaagagatttaaatgcttatggtgtgaattcaaatttattcaaatatgaatgctcacaatattgacaggccagtccatagccagcccaacatggaaagaggactacaggtgtccatgcagtttgttctaagttatggctgcagctactgcctgtctctgagttttaaggatgatgtctctggtgactccattcttgcttacttatagaataaagcattcagaacaaataagccagtgaccagcgatttatatggccaaaggttctgagcttgctaaatttatattattttactatcctaaacatcaaacatttaagcgtgtatagttcttgctcacagatgagtaatagaaattctttgaaagatactatagattattataatagtaacaataacagctgccactgattaaacttgttctatatgctaagagtatgctctcacatttgatctttaagcaatcccatgggtaactattattgggtatttttttgttattattatctctattttacatttgaggacattgaatcttagagaagtcgaacctcttgcccaagatcacacagtgagtaccatgaacaagaaataaaattcttccctgtgtgaacctaaagccagggcttttaactatggctaactttgatgggtcttaatataaaaatatcttgacatgtttttatgtttgttcatttctattaattatttataattaagttattaaatattgatgtatattcatattttatattaattcaataaaactcttaataaacctctaataacataagccaattaactaagtgaccctgggcaagttatttatttatttatatttaattaacacatatggcctttgtgctagacactgtcctaaggagtctgtaagttttacacatttaattcatatttcaactcaatgagctaagtactccatttatacaagaggaaaccaaggcgtagagagttgaagtaacttggcaaaagtcatacagttataatagacttacatagtcatactagtcatacagctagtcaaacggccagtaatggcaatgcccttatctgcaaaatgagaaggttgtagtgggtaaccccagaactcttgtcacctctggcattctgtaaactgtaaattttgaatttctggcttgattaatgattgattaattgatttttggttgagcatataagaaatatgctgccacagaggaaaactggctttcgtagccctttctgaccacggtgtttctttcagctcagcaaaaggcaacatctgtgtatatgcagagtacatatctataccctcaatgtatttctgacaagttcagcttgtgatccctgtgggcatagctggtaagtaagtttaaaccatcatttcccaaagacagaactgtgatgaaatgattacttcccagacactggagaataccactcctgatgcagtttgggatgtctttgtgatagcctggcaagaatctccagaatcaatcataagagacaagacacagtaacagaagtcagacggcctgacatagtgtttgttgaccataacctgaactggagcctagccattgatcagctttgagaattcggctgtcagtggtttaagcacacatccttaggaagatcagaagcttccctatgtgtgaaaagtaacctttgctggcagagcaatgccataacttactttcctaggaccctcccaatgtgcatagagatgagtggtgggatgctctcttatggagcaagcaattttgttagttactattgatgtgctcagatatttgtagctctagctactaatgagtttcagtaggaatgccagcatgaactcactcagcccagtttatttcagcaatacattactgtgacaggtgatggtgatcctccacctagtttctctttaccagactggtgcccttaacttcgttcttctgggggtgttagctgctcatggctcacacttttatcctcttctggaggattttccacagctgatagggcctgccttgtgcatatacctggaaacttttattccttttcctggaggtggcccattgccagtagggccgatgtaggtgtgcaagagtgtaaccccctttccctgggagtggaaaagtgatgggggagctctctgagtagaattcattctctggttctctctgtggcatcggagtaaggtgaatctccttctggactctttcttttctatcctgttcccctgtagccttacaggtttctcttgaaagcaacccctcaatatgtcacttacacaagaatccagatctatcaagcaagaggaataagttcaagttcataagattcttgtctttaactgctgagccccacccccatccttggcttgtgtccatccaaaatgtcagtactctttgattgcctcctggctcagttaccttcatgttttactttcccctcatatccctttcaaacaatagaagcttctttcactgaacataactgcagctccttcaggagatgggggaagaaggcagtgtcagaagagagactattctgcactccttggagaaccagtgaccagtgggtatgatatttaattttaccaggagcatgcatcagaaaatagtccacaatatttcacacaaagagtcatatccagaacaaggaaattaaataggttttaattgaaaccttaatgctacatttgagaaggaaggtcagattgaaagaaaattgatttctgtaattgataattctttttcccacatatccctgagcacaataatcataactcttaaggaactcagaaatgcatggtatacaagggagtgacatgagtacacttatttcaaaatggagagagagacttcctgcctcaaactatcccagatatttaaagatttgaaacatttaactaaatttttggtaactcaaatgttttgccactcgttagacataaaatttgttttctatcatctgtcagtttcactctacattttatttcatggatgagacagaatgatcattagtagttagttggttgtaaggggaaacataaaataaaaatagaagttcatgggaaggattttccatatgcatctgcatggaaaaaaatttaagcaaaaggatttaacgtgctgatatttcaaactaccttttcataggatgaaatatgatttgcctgtatgtgattctgaaattcagatagtagaaactctacgggcaacgctatctcctctagaagttggtaaaataagaggcaagtcttattaaaaataattataattcttttcaaccaatatttatcggtgactcactcagggtcaaaaaagtaaatattttttaacggtaagaaggtacaaagaacagtatgatgccaaggaacacatgccactttttgatggagaatatgaaagcatcctgggggaagaaagagatgatgcagaccattcagagcaggtaggatttggataggtataaatcgatgttgaaaggaaggggctagcaacaagaaatagaaaggctataggctcattggaaggaaaaggtaggcattgttcaatgaaatgccaaaaaatatttggcacttcggatactatagaggatgcggaaaagtaatctggaatggtaggttggagctatggaaagagaatcaaggtgtttattgtttcagtgaatgtcaaaacatatgagtgtgtatatattggaatagaatgaagagatctcaaaggtggaccatcagttagagtgattgatatggcagtgatctaaaacaacagtccccagactttttgaaccttggaccagtttcatggaagacaatttttccacagtgtggggggatggttttgggataaaactgttccacttcagttagattctcataaggagcgtgcaacctagatccgttgcatgtgctgttacaatagggcttgtgctcctatgagaatctaatgccaccattgatctgacaggaggaggagctcaggtggtactgctcgctggcagctcacctcctgctgtgcagcctggttgctaacaggctgtggaccagtaccagtccacagcctgggggatggggactcctggtctaaaataagtaaaggaggcatgaacacacaggtgacagtggaagtcaaagggaacaagaattttaatagagaagaaaagatcaatgctggcacaaactatagaaggaatgaggaagaggaaggtcaaaccaaagtaaatcgatctggcaaagaggaagtcatttggtcaaccaaagccggtatttaatctatactgtcatactgcggattcctcccaaagccaacctcagcaacagaggttgagtagtggtagtttgtttgagaggtagccctaggaagaacaaggaagggggtcagaacagtgaggcaggaatagcagaagcgaatagaggatacatgaatgaggcagtgagcaaacggagatcctccagagggatccatagaatgtatctagaattgttccactgagggaggggtagagcccagggatttgtgcagtgatttcggctcctaattgcttggcagttgcccgcaggggcatcaaatcccctcttcaatggactggtctgctctgagtagggcaagcccctgtggccctgctcaggtagaaaagcagaaacattcaagccattgaattatgcaaggagtgatccactgcagcctcagataaacttagaggtaagcaagggtataaataacaacttcttcaagtacctacaagttctaggtgtttgcaagtggcttctatttttgaggtcacctcacagtttaagatggctgctggcattccagctatcacagctactttgtggacagcaggaaacactcatagaagagtccacttcgtttaatcagccttcctgtaagtatcacagaacattcattcaccagaaacagacatatgaccaatcttgctggaagggaggctgggagatgcaatattttagctcgacatattattgttccacatacaattgtgcttggttttaaggaaggaaaggtacatagaggttgtgtgatagccagcaatctctgccataccatataaaaacatatttaagtcagagttttaatttcttttttatttattgattctgtgtcccacccactagatttctagttccttgaagacaggaactgggttagctttactgtgttattactcactgtgactcatacattgaggtttatttttttcccccagaacagtctagcccactttatcccttttggctttttaagtaaggacatcagtatcattacacaaattaaagggaagagaggatgaggatgcccaatagccagccataatgagaagtcaggaattccaaaacttgaattttagattttatcaaagaagcaggtggagatgaaaattatgggttatctgatatatttaattattcaaaatcgtaaacaaacgtactacacagaactctttataacaaattcttcatttttcagcatacactcacccaaacataaacctacaccactattctctagccggagccatagctgaaggtatttttaatgcctttcatgttagtgaaaatatctctgtagtagctatggacttgaactcagcagaccaagatatgagtctctattttctattaccagcaagcaagcactgacaagctgtttatcatctcctatcctttgtttcctcacttttaaaacaagcatagtcacactgcaggggcttttgaaaggaatatttgaaaagctcctgcacaagtcttagcaaagtaggctatcagaacacgaactttaatctgaatctcttctgttgtgtccaagactaaagaggagtctgacttgatctttggctcctttgacattgggagatcactgctacaaacaatcatactgtgagaagcccctgggattcctggagattcctgcatgtctgtctcccagactcttaagcatctggccttgactttctacaaaatgtaaaggaggcctccaaatgacagaccttagggggaacatctccaaatggttcttccaagcacaatgaatcaatcccctctccttgcatattctgagaattagcagaaagtacatacatatttcagagttacctcttaatacaattacagttcattcagccagcaattacagtaatagaaagattggcgactactgcaaatcaggtttaagagaactgatggcccaaggggctaacgcttcattctgtctggctctagtagcagacttggtgggcttgtgacccccatgtggtgtgtgtgtgtgggtgtgtgggtgtgtgggtgtgtgtgtgtagggagactgggcactcccagtggtgtaggttgactgattatggtgaccattttattatttttatttttatttcaacagtttgggggatacaggtggtttttggttacgcggatgagttcttcagcggtgaagtctgagattttagtgcacttgtcacctgagcagtatagtctttcatccctcaacctcctccaaacttctctgtacccccaaccccctcccgagtccccaaagttcattatattactctgtatgtctttgtgtcttcatagcttagcttccacttgtaagtgagaacacatgatgtttggttttccatttctgagttacttcccttagaataatggcctccagctccatccacattgttgcaaaagacattatttagttcccttttgtggctgaatagtattccatggtgtatatacaccacattttctttaccactcattggttaatgggcacttcggttggttccatatctttgcaattgtgaattgtgctgctagctataaacatgtgtgtgcatgtgtcttttccatataatgacctttttttttcttttgggtagacactgaaagccttcacctcctggtgaagacaggaggttattggccatgttagacactgaaagtcttcatctcctgtggctcctatctataccagcctcatagtctggattctgtggttttaagaaactactctgaagaaataaatgtggacagagcactacaggaaaatggtgactatagtaaaggcagggggcacgggtagtcctctagtgcttagctatgccccattccaatgttgatctccaaataacttctcactgaacttcatgtaagcctttgaagccaattacttccaactatgtctcattctctcaaattaaaatctacatctgattcattctctctgaaatacatatgcccagatatctaaattcaaatggcatctagctggaaggttggaatacccgtttacttcctacaaatatattcacaaagaagaaatgattttaaagaacagcaacaatgacttaaaaaacctaaagacaaaaaacaaaaacaaacaaacaagcaaaaaacgcccggcatggtagctcatacctgtaatcccagtgactagggaggctgaggcaggaagacaacttaaagcaaagagtttgagaccagtgtggcaatctactgagaatccctctcctaaaaagaagagaaaaaaataaaaataaattagttgggtacagtggcctgaacctatagtcccacctactcagaaggctgaggcgagaagatctcttgagcccaggaatgagtttgagtttgcagtgagttatgattgcaccactgcattccagtatgggtgacagagtgagcccttgtctcttaaaaagtaggaaataaataattttaaaagacaaaatagtgttagaaaaatggtagattgaacaatatttataaagtagaccagtctgggttagagcaaagacgaagaaaaagaaacatagaaggcagcttgacactgcgttcctgttctgttcactctccagaaatccagcaacctatcaaattaaaaagacctagcagcttatttctctgtaccatagactggtttttatctccactctgctttagactttatctctaccatagatttttaaatctgtattgagagaaagaaaatatcttaacgaatccttgtggaaatagaatttcaagcatacttgaaatgttctccaaaactgtggaagaaaaaaatacatgaaaatgataaaagataaactgatagacattgaataagaatacaggaattttacctatgaacaatttctccttttggaatatggtttgagacaaagaaagaatattacagcatatcagaagaagaaagaaaggtaaacagaaaggaaaggacagagaaagaatagaagcaagagaggaggggaggaggggaggaggggaggagggaaggggagaggaagagagaaagaaatggaagaacagagaaagggaggaagaaagggaaggaaggaaagaaggaaggaacaaaaagaggatggaaggaaggaagggaaggaagggagggagggaaggagggagaaaggaaggaaggaatgaaggggagaaggaaggaaggaagggaaggaggggagaaggaagaaagtcctttcatgcactaaagaaaagttagtacctacaggtggaaatagagttataactgataatttattgatacctaaacagaagaaaaaacatggtttttttccaatcatgagggcacaaaaaatttctatattggcatcatactttactgttgcaaaagtggtctttctgtaactctcttaaacatttatttcctcataatcacagagagcgttttccatgtgaattcgcacaaattccttgcttagaagccctcactggctctccctcatccacccagtaagtcccagattcttgaacaagacttggcctataactctctctcatgtctcctgcaactgccaatctgtcactctctcaagagccctgcaaaaaccatgctactcaataaaccacagacgtcctttctttctatgcccacttaacgttacttttcattcagatcttttatatcccatcttctccagaaagctttctctgtaccctcttctcaaacaagaataaatctttgtatcctgtgctaggatataatgaaaacagatcttctgtattaatttgtattaatagctttttatgttaagttgaatttttccatgtttgttccatcaagttcctcccctaagattgtgggtgttctcagaattgagtatgtgccccaacatctaacatggtatctagtccataatacgtgtgagattgtgcttgttgacctgaatcatggaaaatgcctgggccgtatatgaagtacagaagagctccaggtgtgaggtagtgcttggtaagataaagacttcaatgtagcacctggtattgtgagggtgacctgtctttcctgggtcttcagcaatgtaggaacttctttggcagtagttttaatttaatcctttaatctctaattttgcagcccatttagaaataaaaaaattacaagcaaagcttttggtttccatcttaattgtattactttatcaccaatatagaacagagagatccatagtggattacaataagtggagaggccctgtagctggagtgtgcctgcagaatttctaagaaggccagcatgcctgcagcatagaaagcaatggagaagggaaatggaggatgaagtcagaatggcgacgagggaccagatggtggaggctttcaggtcattaagggctttacttattttgaatgacgtttattttgacaacaattaatgggttttgagcagaggagcaagaagacacgacttacattttatcgggatcatttcagcattcttgaataagttgaaaagagaaatcatttagaaaacatctgcacctatccaggtaagacatgatggtggaccaaggtggtagcaatggaaaggaggggcataattggattagggatgtattttaaatgttgagccgacaggatttgctggtgggttgcatgcaagtcagtacttaaatgagattagccatggaatacaagcatcaaaagtaaagagcagagatgatgaaagtgatggtgaggtctgggccattctaagaattctaataaaaatcaaaggggtaagggttgatgtcagttcacaggctatggaactgtcaagaccaaagaccctgtgaggtagctgaagcaggaaacactttccttttatgtatcaaagtctccaatcctaatgctgtgctggagaacttggacctatggtgcaacctggcagtcaatgaatcaggaaataaggggtcagcctgatagaacatttaggagggagtgtgactcatagatgacaatgtcttaagaaggtctagtatgtttactcttaagcatcaagaaacaaatgacgattttcaatactcggagtatactggcagaggaatcctgaatcaactggcataggtctgccactgatgcaggaagttgaacctggcagctgcagccaatcagagctgaagaacagtcaagtcaaggtcaggacccctcttccagcctttgagcgttggcttctgcttccctccctcagtcctgatattccttactacttccactttcaaataactgaattacagccccagaccatcttgttctcccttgggccacagcaatgcaatccaccttcttcttaatcctcctgcagctccagcctgcagtttcaagacaggtgcacaaagttccttaacagtttcctctcattcagacacaacttcaatgaagtgaagttagggaacaaaatccactctatctactgcctcctatctttggtccactcatctcttattgtctcaagtagggattccctattctcattcttagctctgtagaactctgctgcctggaattcctggccctgtcagatgaaacgcgaggggaaaatttagacagatacaaacttagccatcatagttttgggtaaattttatattcacagttgtctgatttggtactgttcaaagctttttatgacaagatcataatgacaaaacttttaggtctcttggcagggaaatcaagaatgttcttggagcagctagttattttatatatagagagatatctatctatcgatataaataaaacatgtatacatatatatttatatataaaacacatatatacatatatacatgtaaaagtctatgtttacatatattgtttatctagttgtatgatcactctgcccttaaatgagataatttgattatatttgaaatcatgaaacgtgaaacaaatatgaaatccagattgttatagcatgatgtaactaaaagataattaatttccagatgtttttattcctttttatagtaatcttattttgctgcttatacttattgacatttactttatacaagctttgttctaatttcatctatctctctagaaaattatattctcacagcagccctgtgggcttaatgataatatgacatctattttacagatgtggacacttaagattgatcaaaatcaagtagataacaagtgttagggttggaatcaaatctagacctatttatggtcagattccgaactcttgaagagttcactgtatggtattaactgacagtaagcacatttaaagcgttctcttgggctggggcataaatgtagcccaactatgtttgcattcatttccaaactaaatgtagttaaattcaaaatttttcacaaaggagcagttaggagtttgtctaaatttctgataccctgtctctgaatgtggtcctaaaggaaaagaatctgaaaatccccttgtttctagagacaggaagtggttcttgcaggttcttcttttacaagaatattggtctcagtaaccagaactctgattgcaacatgtaataaattcaatatcactggcctttccaagacaagaaaatgaggaataggttattcattttgctgaagaagagaaaattttcaactaatgtttcttcagtaagaaacctactttgacaaagaagtaaaagatatgtcaataaggagccatattgctgctgtagaagattaacattttgcattgaagtgttggttctgataattttagtaaactttcctgttgacccatctctccaaagttgctgacactttggaattgtgtcccggtggcaaaacttgtctgaaagatgaatcatgttttcagagtttctgtcttccctgctgttgacagacagcagcccttgtcatgcattagcagggcaaggaattcttaaggccttctgttgagaccttactgagtgaaatgcttattattgaagtccctggcaagagagctcaatggctaagcaccaggccacagtctactgtactcccactctttgaatccatggtgaaaataatactctttgaaatgtgttaggaagagaaagaaaactgatgttggctaccatgctaattacagagcttaccagtaagatcttttagcttagtcatgcaagctgtgcctacactcatttattcacttagcaaacattatgaggtcaattttaccaattgttaatgtcttatgtatcctggatttattgtggactctttatagacaaacttcttgactaatagatctatgatcatttttctctgacatctaatccatttccaacccctactaatctggcttttgtcatcacaattaaaaacaagctttgtggtgtttcttttcttacctcaacatctcactgctctttggtaaatggaacactgattttgagctggaaacacgggcattttgaataaaaggactacattctccatccttcattgtggttaggtataaccgttttatatctaattgctggccgatgagagataattagtagaagcagtggctttgttttgtttattttttgttgttgttttttggtgggagcagctatataaagtcagaggatactgctggaagtgccactgtgcctttctacacttacctcttcttttggtttttagcaaacatgatcgctggagatgcagcaactatcttggacaacaaggtgacaagaagcttaatttgacaacaatacaaaaagatagtatcctgtgtccctgatgacaccaagagggtgcatgtaagtcttggaagcctacttctaaatatttgtatgtgagagagaaataaactcctatgctaaggctacttttttgtaaggttttctagcagtaagagattacaaccttactggtctgaggtatcaaagaatacagttcaaggcaggtaaagcaacctaatatttaggagagaattcctggaattaggagaattgaagaaaggctgagactacacttaagtataaacccttcctgaacaccttactgacaattaaactatacacgcctatgggagacaccagaggccaggcataagcacaggtaaaaacaaaagaagtttctattcttagaagctagaactacattgggtgagatttgttacatttttgactgagagcatgctgaagtggcagaatgctaaaatcttcctattctgaagttaaaaaaaaaaaaagagagagagagagagatcttggagctggcagagcaagctggaaatttacgtggaaaaccttaaaagcagggaatcacagagagggtgagtcccaaaatctatatgtaaactctgtccaaatccctggctgacagcaaaactacacaggtaaaggggagacccaaaggaaataaaggtaaaaatacaactgctggaaacacaaagaattgaggagaaataacagctgttgctcactgcaggggacagagtttgcagttcaagaacatgccaagtactatctgtgaggttttttttttaatcctcagaagaacataagagcatccaaatcactaagatatatagacttcaatatttatctttcaaccaaaaatgagtagtcatgcaaaaaaatttaaaaaaagatgagtatgaaccatatacagaagaaaggaagtcaatagaatttgactgagtgtgcctgatgtcagatttagtagaaaaagaattttaagaagctattattaaggtttcaacaattaataaaacctatatttaaataaataaggaaaatgtctcgatagttgaaaagttagagtatatcatgagtgaaaaaagaaaaaaacaacaaaatgaaaattattgaactaaaaattaatataactaagatgaaaaataaatcaccactacaaactaaagtgcttcttcacaggaaaataaacaattaaaaaaataaaaaggcagtctgttgtttagaagaaaatatttgcaagccatatatctgataaggggttaatatccaaaatatataagaaactcacataatttaatagcaaaaaaaaaaacctgattaaaaatgggcaaagaatgtgaatagacatctttccaaaaaaggcataaaaatggccaactgatatatgaaaatgtgttcaatattactagtaatcatcagggaaatgcaaatcaaaagcacaatagaacatcacctcagatatgttaggatggctattatcagatcgacaataaataacaagagttggtgagggtgtggagaaaagggaactcttgtatgctatatatgggaacgtaaattggtaaaactattatggaaaatggtatagcagttcctcagaaagctaataataggactaacccatgacccagcaatccatctgctgggtatatactcaaaggaaatgaaatccgaacttcatagagatatataaatctgtgttcccatgtttattgtaccattattcacaatagacaagatatgggattaacctaagtgtccatcaatgaatgaatggataaattgtgatatatctgtgggtgtgtatgtgtgtatgcatacgtacatatgtatctcaatgtatatataatgcatatgtgtgtagatcacaatttctttattcatctgtcaatgactacttaatatataatggcatattattcagccttaagaaaggagatactgctttttatgataacatggatgaacctagagaacattatgctaagtgaaataagccaagaacagaaaggcaaataccacattatcacacttacatgtggaatctaaaacaagtcaaatatatagaaacaggcagtggaacagtgattaccaagatcaaagacagggagaaatggagagaagtaagtcaaagagtacaaacttgaaattatatagaaagaataagtctacagatctaatgtactatagttaataatattggattgtatactgaaagtttgctaagagagtagattttaagtgttcttatcatatgcgcacacacacacaaaaataactatggaaggtgataggttaatttgcttcactgtggtaatgatttacctatgtatatgtatattaaaacatcatgttgtacaccatacataaagaaaaaaattaccaggtttgctgaacaacagattgaaaatgacagaagatagaattgttcgatttggagttagagtaattgaaattatacaaactgaagaacaaagagtataaaaccaaagaaaatgaataaggctccagagatctgtggaaaaatgacaaggagtccaacatacatgtgattggagaacacaatgtggagaaaagacagaagaaaatacatatttgagtaaatagcaactaaatttcccaaatttggtgaaaaccataagcttacagattcataaatctcaatgaccctcaaataacataaatgcaaataaaactacatttaaacacatgatggtcaaactggtaaaaagcaaacataatttaaaaatatgaaaagcagtgaaagaaacaatggaacaatcaatagtttagttctcattggaaatagcggaagtgaaataatattggaataaaatagtcaaaatgccagtttaaagaaaccctctcaggaatcctatatcctgtgaaaatatcattaacattatagacaaaatagagaaaatttcagaaaaaaggtttttctgcaattatttatcaccagaacaaggaacattttctaatttattttaagaggctagcattacactaataccataaacaagaattaatttattattacaagaaaactaaaaatcaatattacttatgaaaatataagcataaattcttttaaaaataatcaaattgaatttatcaatatatgagacaggtactatatcataagtaaatggacattatccaaacaatgtaaggttagtttgatattaaaattttaagctatataagtcacaatttgatcatcttagtaaatgcagaagaagcaaacagcaaaattaaactctcactcaggatttataaaaatctcagaaagctaagaaaacttttgggttgattaaaaacattctgtctcttaattgtggtagtagtttttggaatgtatccatttgctgaaacccattgagctgtacacttcaaatgggtgcattttatattatgtcagttatattccaatatagcttgctaaagaggaacctcacagggaatattgtacttaattttgcaatgttagaactcttcctcttaaatttggtcaaatgaaaaataaccagcaccatcactacttgctgtaatactggagaaactttcaatggtggctaagaaaaaacaagtgaaatttagggctccaaaagagaaaacaaaataacattatttcacaggcttgacaatttacttagaagagcgtaaaataatctacaaactgttgcaatgcataaaagaatttagcaccattacagcctcaagatcaaaagtcaaaggtcaatagcattcctatgtcaaaataaaaaaaaactaattaatacatagtcatagtctataataaagccatatgtttgaactattaacaaaattattatcaatttcctgaaaataactcttaaaatgatatggacttttatgtacaaaacaaagaaactttatcaaagtacttagctggggcctggttttaaggcaaaagtggcttttgcaaatcagtaagaaaatgtgattttaagaagtaattttatattcctatgtcataccaccaaagaaaaataagcttcaattttatttaagattcaaatgttaaaatgcaaaactttaaaactacaataaaaaaatcctgggagaaaaatatcactgctctttgaactttccaaggacactcataccacaggaccttcacacgtgctgctccttttgtctgaaatgctttttcaagatgcccccgtgccttgttccctttcctctgtcaggtctctgctcatttgtcatttctcagtgggactttcctgaatcagtccatgtgaaataataccccccagctccagcactttttctgcccctatgtatctctctgtttatcatcacctgaaatatttacattttttttaaggaaggagctttgttttgttcactgttgcatcctgagaatctgaaatgaatgtattttgaaaatataaagggaaaaatagcaaatgccaatacttgttatattcaagttatgaattttagtagttcccaactagtttcatagcatatatgctgtttcttgttttctgttttcaatatgtttatgattgtaattaaaatgaagaataatataaaagattgcaaggatgttacatgccagaaaataggttaatattattcagtgcattaagagatgatagctaagaaatcatttggatgttttgatgtctggcaaaaaagtcacttgataaaatatagcacctacttctgaaaaattaaaagcaaaaataaattccttaaaatataaatatgtaaagatttgaaacttgataaaacagaaagtcaatgacactcatcatataattttaaatttgtcatccattgctattaaagtaagcaaattgctatgcaaacgaattttgaaattctaaacaatgcaataaaatatgaaaaacaaataaaagtctaaatatttgtagtgaagccatgactctaattttttggagaaataagtaaattttttcagataaatccatggaaatcaactttagagcttttaaaactaaaatgttaggaagccatttcactggtgactgcattgaaatcaatgattttctgatgtccaagcagtaacgaatgagaagttccagatagaaacaaaccatctacaaggagccaacaaaacaaaggtatgcacacacacagagcaaataagctacaaaacatttgaagataatagtaagcacaaatgctcaagattgaagaagagcattcaagtttagttattcatgattatattccccaggtctgccatatattaggtgcttaatgaatatttaaggaatgaatacatgtagaagaaacacctaaatatgtgtagagatttaatcagttcttcactggaagacccaacgttaaatgaagtatattatttccaaaattatgtacaaattcaatgcaatgacgtttcatttgaagttgtgagccacatataaattaatacatggcaaagggatatttaaaacttgttgaaaatgtatttataatttggctgaccatttgtaaaaataagtcttttagttagatagcattaaataaaaataatgctatctagggtctctgctttatgcattcataattattagtcatttttatgaattggatagacttttatataaaaataaatgctaataattggaaaatatttagatttctggtgtcattttcattttattattttaatagaaaagcctatagtgattcagccttaagtatgacattggccattggtataagaaaaactatactttagattgcttattatctatttcaattttacttataatacattttgtcattgtttattcctaaagaattttctgttttcatcatatctcttttgaaatactctaataggatattttttcttctattttcagaaaccaaagtatcactgttttctgtttactgtcagcatttataataaatcagaattttatcaatccagtaaattaatgaggaagccagtcttgtattgtttaaataacttatatagtttagaaattatctataccttccaagatcaacgttctatataaaaataaaaaaccaccagtgattattcctaaatcaagtacaattgaattaaaggcaataaaaaacattaaagagagaaaatcctgtccattttgtacaaataacaaatacaatgcatagtgctgatataatcattatgaaattttatgtgccaaataagtaatattaaactatataaagcaaaacgtgtaagcaataatatgagatgctgggaaataaagttatactaacaaccttaaccacgatattctttacttaagaaatatcaagtagataaaaataactttcacatctaagaatatgctaacaacacaacttatagcaaggagaaatttaaaagccataataataggagaatcattaagtcattatgattggtcaataatacagaatgctatgcagtctttaaaacgcacattccaagtgatgtttagagatatggaaatatcactggaatgtcatttttaattatagtctctgggaaattttaaagggacaggaaactatgaacaaagtgaacagtataatgataaatataactatttctcacttttatctcattttacatgtagtctgtctctctctctcacacacaaacacacacacacacaaatacacttcctatactagttccattttcttctccttcttccattctgacaagtaatcattatcaaaaatttagtgtgtatttttttaatccattttatatattcacttaatgtaactataaataatatgtagtgtttctttggtttctatttacatcaatggtaatgtattatagtaatatcagctattaattttcaattttataagatcacatttctgagatccattcacattggaatgtagtagctatagatttaaatatagatgatatagtatttaatattttgtgcttttgccttacactgcactttcatttcctgttttccacctcaagctaaaattttagcattttacttttattctttctattaaagtcttctttgcacataccaacttgtgcacatgttctagaattttctagaatatagacttggaaaaaaactactaggctttaaaggattttattttattttattttttatttttttgagatagagtttcactcttgtcacccaggctggagtatggtggtgtgatcacagttcaggacaacctctgcctcctgggttcaagcaattctcctgcttcagcctcctgagtaggtgggatgccgagtacctgagattacaggcacgcaccaccacacctggctaagttttgtatttttagtagagacagagttttaccatgttggccaggctggtctcaaactcctgacctcaagtgatctgcctgccttgtcctcccaaagtgctgggattacaggcatgagccactgcgtgcctggtctctaaaggatatctattttcagttttatatatactgccaaactgttgttttttttttaatgattgtaccaactcacacagcacagcctgagaggtccctttcctcacttctaagtctagatgtgttactctccaatttttttttttttgcatttggatggcagtaaaatgtatctcaatgttgtgctaattttcattttgctcatttctagtaaatttgtacattttcttatataattttggcctcaatgctctcaagtctacaccccaccccccatgaatcacagggtaatcaactctttccattttcttatgcatttgaccatttttgtacagttcttggcataacctggataataatttgtcttttatgtactatgcaaatattttctcccacacaaaatgggacttttaaaaactttgtctaaggtttcattttttagtgtgaaaatttttcattttgatgtcatcaaatatttcagtcttttcctttgaagcttattctttctcttgtgtgtttgagttatttccctatcttgatatcataaaagcctttccatctgatagatttgattttttaatattaatatttaattgtgaaaataggaaataatgtatttctgagtgactataggagttattttagatatatggagaacaattaagacaatctaatatactaaatatttcaatatctcctcacttttataatgctaccttatttatataaaatgttggatatgatcattttattcactataattttataatgtcttcacagctgttcaagtcagttttccctcaattatcttcttctactatcttataaaattcaaaattgtcttgactttttgaatattattccacatgcattttagaattaacacgtcaagttttataaacaaacttttactttttggcattgcattgaactcactgataatttaggagacagtttgtatttgctatggctccttttctaaatcactccacagtaatcttacaaagagcattttcaaagatgtgtttcttcccacatgtttaattaatttactgtgattaagaatgagactttcggccgggcgcggtggctcacgcctgtaatcccagcactttgggaggccgaggcgggcggatcacgaggtcaggagatcgagaccatcctggctaacaaggtgaaaccccgtctctactaaaaaataaaataaaaaaaaaaattagctgggcgtggtggcgggcgcctgtagtcccagctacttgggaggctgaggcaggagaatggcatggacccaggaggtggagcttgcagtgagccgagattgtgccactgcactccagcctgggtgacagagcgagactccgtctcaaaaaaaaaaaaaaaaaaaaaagaatgagactttcaaaatgcattttctcattggttattgttgatattaatatgtatgaattctcttaatttttgagttatacataatatcttaaattcagacacttttctggactatcacaatagtagttttaagaataatacttttaagaaatgtatatagttgtcttaatagatttaagaaatgtatatagttgtcccttcatgtccatgggggattggttccaggacccacagtggataccataatccgcaggtgccaagtcccttaaataaaatggtggagtattggcatataacctacacatggctgctcatagactttaagtaatctctagatgatgtatatacctattaaactgtaaatgctatgtaaacagttcttattctgtattgttcttatttgtatttttattgttgtttttattttttcagaatattttcctgcagatgtggaacttacatatatggagacccaatggaaacctcctgggttttctatgcagacaattatgtctgcaaataatgagttttctaaacaaattcctttctgattttttttttgcttgtcttattacattgcctaggaataacattattataatgagtagaactagtgataacagtcttttgtcttttttgtgcatttaatgcaaatgctcatctttactattaagtgtgctaacagctgaagttatcaggttaatatacttcaccaggttaagaaggtttgtttctatttctgttttgttaaactacaaaaaaaatcataaatgaaaattaacttttcctcttgatttatcacatttatttaaataaacacagttatgatttctcttttaatctactaaaatgttggagtcttctctaatgttgacccatcattacatatctaagatgtctgagaaatacacatttgaggtaaattctacttgtttatggttttgtaaccataccagacaaacctgtttcaacttttatgtaagaaagttgtgagtttttcagttgctatggacccccacacattgacagtcacataacctgagcatgcccagttgaaccaactatgcaaccacagttggaacttaagtgctcagaccaagaaacagggacttaattaagacatggataccacatggaacaatccaggatccaatcagatcaagacttggtgtcaccttatagcaggatcctgtcagatcaagagatccatgcctagtggaatcatctgatttaaaaatccaatcaaatcacacctcattactctatagctataagacctgccccagctctccagctcaaggaaatggatttgagcctttcctcctatcttcttgccagtcagcttgcagagaaccttttcttttctccaaagccagtgccatgacattggcttgtatgggtatcaggcagtgagcccactgattgtttggtaaaaaattttaagtgacatttaaaattttaaataaaatgtgaattttgacttgctgacacttatcttgggagttctccatgaacgttcataattctgattgacctataattttgtcttattgaactgcccttgccttagtctggtattgatattttaatattctctcaaagacctgagaagcttttcctatttctttactttctgaagcagtttataaaataagtggattatatttttcatcacgtgtagaaaataaaaaattcttggccctagtatcttaacatttttctaataaaaattaatttttattataaaaattaaaatttgttattaaaaatttaattttttaattgtaaaaattttttattataaaatttaaaaaattattacaaaaattaacaattttttattatactttaagttctggggtacatgtgcagaacgtgcaggttttttacatagatatacacatgccatggtagtctgctgcacccatcaacctgtgatctgtatacattaggtatttctcctaatgctatccctcccctagcccaccaccccctgacaggcctggtgaatgatgttcccctccctgtgtcaatgtgttctctttgttcagctcccacttatgagtaagaacatgcggtgtttgattttttgttcttgtgttagtttgctgagaatgatggaaaaattatgataaaaaatttaaaattttcattataaaatttaaaaattttataataaaaatttaaaatatttattattaatttaatgtttatctttttataatgacctttttcttgttgattctattttggaatttttttcttacatttcccattttgtctaactcttctcatttactgccatgaagctattctgatatctgaaacctctcttgacctattattatttattcctctccatttcttttcataattaatttataatttcctccagttttttttcttgatctgtttggtttatttgtattagtcttttctgcagactgtttatggtttcactgaccatgtctaatactatgtatattttaaaaatttatttatgcttttctattatttccctccttcagctttatttacttttaaaatgttttcctagtatttcttaactgaatgcttatctcattaattttgaatttttttgtttctaaaagaattacattaaagagctgcaattctctttaaatgttagtttagctgtatccctcaattatatatataataacttcactttcattaaattctaaatattttctttattatatcatttccttttcttttcttgtaatttatgatgtttgtcaggccctgcaaagttaatgatgttttaacctttcaattctttcatggctcttcatcaattgattcatgtctgctcccttagcctatgtgttccccaatggcaggaattatcttcatttaatcccctgcctaaggccctggtatagtactgggcataccacataggcatagataaatagttgtcaatttcttacacccattcatacattgattcattcataaatgcagtcattcatttaatagatatttcttgagtttctgagaaggttataaaggtaaatgttctaggcacttagattggttatactctgaatattgctggcatctagtaatctgcgacatgatctcatttgtttaaaggtgtaattcaaatatcagccactatacagataacattattttcccataattatttcccccagatctttcattttgttattttggcttttcgtggtagaatcagagtccatcttataaattaataatgcagcatgccatgttgaggtgattaaagaagaaactgtagacccttttaacttttccttttgcttggatagacatttaagtctgtttgattttagttggggtttattttttgctctgctgccattggaatcatttaggatgctttttaaatcactattatttgaacacgagcccagatttaaaaaggcaaaaatacaagataagtcagatgtgggcctgggcaatgatattttgtcaaaggctctcaaatgattctacagtgtacttacggctgtagcaattgaaaggtatttattgtttaagctatagcttacagcctccttatacttacgacatttcatttactatttctcttatggtttctggggaattcaaacatggttgagattgcaagttttatacacaggatgtgcaggcattggtaaaaagattttcatgttgctttaaagtaagcatgccttttataaaaatgtactgtctattcatacctgagatgaagtaccggccaatctgaggctctccctgtatctgagaataaagaaacagtgtattagaaccctgcaggttccattccagatagacaggtgaggtcatcatggtggatgtctcatgaaggcttccagaaacctcagaaacctaaattagttcttcaagcatttggaatgctgctgctctcgtaagcatttggaatcctgctgctgtggtcaagtagtgaggctgactccaagaagagtactttttcatattttcattattttcaccactggagtgaacaccaaacttctgagtcttgggtaattatgaatatactaacttgggaccaaagggtgaggccatactgtccttgccatttggccattagaacttaataaatgagcccctattattaaataaataaaatacaatgggcttgtacctccttgccatactagttcaattttaactactttattaattgaaatatcagcagcagtagggtgctaactgcccagattttaccaaagagtcactaaccattgtggaagtaacttgtgcagtctgcaagtcaggcccatcttataagtcactgcatggatagttttcctgcagtcaccagcaaacctgtgatattaagggtcctcttccctcagtagtcattttctgttggatatccattccaatcaactgctgtatccttaggtaaccttaatttttcttgacaataggcatttctaaaatcctaactaactgtcacaaagaaggtacatgttatggagctaacacatttttgaagaatcaaatgagtgctaaggaaggcagggctaccattgtttggaggaatcatctgataagtatttgatttcttccaaatgataagtcctgtctcctttctgattcacttttttttgaaaaacgtataaaatgatatattttgggctcaaataaggtcagttagaaatagctggactcatacccaaatagtttgttctagttgtgactaaaaccctcagttgaacttttctccttaagagaaaaataacaactctctatatagacatggtgatttgaggaaattctctgatgtagctaatgtaaacaattatgtatcattgagtctaggaaactggattctccaaattatttctcttgtaaaaatgtatttgttaagtaaactgtagtccacaccacttcctcagccttctccaaagaaacacactgcttgaacaatcaaaggattacaaatttgaaagagaaattaaagttcatctcactgaactcactaccaacagaagtcaccatttattctgaaaaaatcaagattatttcccagggactgttttgcaactagcattgtatttagggagcttgaagaaatatatgcatttattcacattttaactatatttcttggcattctttctgcatccagaatttttattttcttctttttttccaaatagcaaacaagctttgatcttatatcagtaaatttattcccaaggtgtcttagtcgattttgtgctgctataacagaataccacagactgattaattgatagtgaacagaaatgtattggctcacagttctggaaactgagaactccaatattgaggtgctgacatctggcaagggcctttttgttgcgtcattacgttgcagggggatcacgtggtggaaaggcaaatagagggttagagagagacagaaaagggaaccaaacccacccttttgtaaagaacccactgctttgataacagccttaattcatttgtgaaggttgagtcctcatggcctgatcacctgttaaaggtcccgcctcttaacactgttacaatggcaattaaatttcaacatgagttttggaaggcacaaacactcaaaccatagcacaagagtaagcagaaaatatgccagaaagcatgggaaaatattactaaagactcatgtcattagtatacaaatgaaaagttttcacttctgtagttattgtaatccaagattctcaaacttcgtagattgggaggatttgattttatacattgtcagttcaatgttgatttggctagaaagatttgatgttacttgtttaactatttgaaactgagtgctatctgtggtccttgggtgcagtggagggggaaacgatctgatgaactcatggaggaacataggttctgagaatgagatgcctgattgatacctggctgaggacttgcatgcttgttctaaaatgtctgttcagttgacctcttcaagcttaattcacactacattgaagacaaatcagctcttcctcgtgtgaggtagacatccatagaaaatacctgagttatcttatcccagggataagataatctatctgcatgcccaattcaagtttgaaaactcctatcttagattattttgagagcttacatcttaaactttagattttaacaagagagaacacattaaatttgacaaaaaatattcattcccagaagatattgcaaaagatttctgatccttatattcactagttattgaaattcatatttggtttgtcctttgggcatagagttgtttgaactaagaataatttattaatttagaagacaccaattattagtttttagaacagacctactctacaattttctaactttgatgattgatacatctccccagaacctgccttaataatgactactcaaaccaaagatctggcattgttaaaggaagaagtaaaccattttttaaaataatcagaatgtgtttaaagaaactatactcttaaaaatattcatttttaatgagggccatggaagttcatcagcttcagagtcacatgcaatccgaccctgggtggttacacttgtcccaaaatctgaacctcctctgtgaagcattcgagacagaaccttgttatttctcagactttggaaaatgcattgtattgatgttatgtaaaaagccaaacctctgttcagtgtaaatagttactccagggccaacaatcctagtgctttccttttttaaaaatgcaaatcctatgtgattttaactctgtcttcacctgattcaactaaaaaaaagtattattttccaaaagtggcctctttgtctaaaacaataaatttttttcatgttttaagaataaaatatttatttttgaatgtggtagatgaaaaactacatgcaagatatttatctcaaaattatcaaaagtcattgagtatttgtgtgcatgtggtaagtgtatatatgtgtacatgctcagtaactatggaaacaaacaaaataagtcctaaaattggggaaatctttgtttacccagtggagaaagaggaggaactgaccctaaataaggaagtcaaaaatgtaacaatacagatattttgaagggcaccaaaaattgagccagaaatctaagtaactgagatgattgtaaataatacacaataataaatataaagcatataattataaaaccatatacaactatgttcctaattttgtcggcttttaagaaagcttgttttctttagtgttttcttctctaggaagcttaggaataactacatttacagctcacctattgcaattgccaatactttatgatatatagttctgagtaggactcagattctatccttcaaattgctaaccaatggcttccattgacttaattattgttttttattgcatctttaaaaataactgacacacattcattaagaaaaaataatgattatatgtaaataaataatacattatctgcctttgtatacatctatctaaatataatatctaggacctttaattgctaataaataagcatgttgccttctttgcacacataatatgtatgctgataatcttacaatagtacgatatttctattctgaagaaggctttaccatattcaactatttaatctcaggaaggtagtttacctctaatatatcaatagcctctaactgctctttgatgcccacaacaagttgagacaggcagagcctcaaggtggtttccctagaataaacattgagtgaaggatgtgaaggtgagtagcttatttgggagatgatctcagaaagcacagcaaggaaatgagaaaagaaaggaaataagacagtacgggatgcacaattgagtccattactgctcattatcctagttgagtaactagggctcaacctcatgagggatatctgttgatggttacagtacagagatgttatcaaaagggtgaggtagctgagctatttttctaccaacttcaatctgtcattgattgaagactgttacaagggtcattgattccttgacacttgcagcctgtcttatatggggggttaagcccactcccaagctctctaaaacatctgttgcaggtgttttcaggaagaagcctttagtagaaaaagcaaatacctaggagatatgaggaaggcaccagcaatgactgttatagagaacaagagagagaactggtgacaaaggcatcttcaaccttcctgaattcatcctttgcatagtttgataacatattattcagtttgctttgtagaacagacaggaggtgaatagtggttcaaatagttaggacaatggtatccttttttggctcttttaattataaattatattcttaggctatctgacatattcagacatcagtgcaagaaaatatttcaaagtcaaatgtaaacacctcttagatctgccactggggtatattcctgctccctctttttcatagcgtggtttctggagagccagatattatcaagtcgtgacagctatgagggcaaaggagaaatcaggaatgagttttttacacactctttctgcagttatttctttccgtactttctataaggcaccgtgaaccaaattccatctggttcccatgcattgtaacactttagatatctgcctcagacttctctggagataaacttctggctaacttgttttaaggccttctgtcctgatccttttatatctccaacagtcagcttctgtcaaacttgtgggaaataaaggattttacagatgctgataaaagatcagaggcacaaacctagtttaaaattccaaaatcgatatttaaaaaagggatgaaaacccccaggaaacccctaggttgtctaagaagtcctcagttcaaagatggtaattcagggatgaatctaaggatctgagtgtcaataggatctaggtttgataggaaaagaacgatctttttcaggatgccatggggactgtttgactttatgaccactgtacaaggtgaaactataagcgaggcagtggggccaatgggaaattgtgcagaggaaaatcatccattctacttttctctaatgctcagttcttaatttttctggaggaaaaaacaaacagagattagagatctcatcggtttatccaaagattccattttaacacacagccaaattaataaggtttaaaatgaccaactgaataaggagacagctgtatatcttcaagatattgtatatgatcttcaaggttaagagtaagggttgaggtgccatttttgtggaatcttctagaacctagattgcaagggttacttttctaagcaaatgtcttcacctgtagatttggcctgattttgtcttaagccaggtgagacagtctgactgttacaggatactggtgtcagacacacgttttccttaaatctgttaaggccacttgaatctgagacttcgttttccaaccaaattatcctgttcctctgtggatctgaaatcctggtctgaacagtagctcttctgcctttaccttgcagacagtttctccaacatttaggttctccccacgcccctaacttcctcatgaataagcaacttacctagatgtcagtgctggtatctggagtctttctgatgtctgcatgttcctggaatatattctcagtacaccagcgtcttcatactcatagtctttcccagcttttgaaacctctacaagccaggttttcagtctctaatctgtctgtatgggactagccagctgcccatgatgggataattcctgcagaccaatggctcagaactcttgactgcctttgttgttcaggtttcaacacacctggagtctcagtccgacatgtttatgctagagctccctatgacagggtgatagagtcatttgatggtcccaggataaggatgttaaatccctggcacttatgacactactccttgtttctaaacagggattgacaaagactttttaatcaattagtgtgcacttccacacccaggccagacatggtcacatggttttcctcactttattattttacacagctaattcccagagatatcagttaaacaaaacccacattctatccctagtggaaagcttgctgctaaggccagtgcttaggagagagggcaccacaagttgactccgaatatgagtttctggggagggacaacatcgctggaagcatgagacagggagctgactggggagagatagaaattgaatcacattgaaggataactaggagcagaatctctaaatggcccaatgacactcaaattcttggttttggccacactcaattcttcagcaatcctggctcagcagttcagggtcagagaagcagagagcagattgatccaaatatgggaagtcccagtagagcaatataaagagccacaaatgaatatattgggaggtatctcaacacttcctattgagtacggaacacacagcatggcactaatcttagtcatggtggtgagcacagcttatcaaagagctatagtacctcttaaagaagcattttgccaagcttaagatgtggctcccctttatcatggagaagagaaactgagattcaaacaggattgctttaatgccacattaataatggccaagtggatctaattgtaaacttgcaatgtttgtttatgtgagtcctacctaatttccccaggatcttctgctcccaaatttttagagctggagtcactactgctccaaccagtagacactcatgagatcctgagccaacattgatcaggcagggcatagaccagccatcatgcccccaacatttgtcagggcttggaataagtcattgtcttttttggagaagagggacaattatactcttttcttcataattacaactctatccttgagattaggcacactcacattaattctgtccctctttcttattttttattaactcctctctatctccagaagaagaaaatcctttaaactgggtattcagagcccaggatattcttgggccttcatcttccagtagatgcttatcctgtgcctgatagatccaaaggcaagggaaagcttcatctttgtgtctttttatgtagtaaataggcctgacaggccctacctgcatgtccagctctctgctttccctatgattgggcaggattggtactgacatgtatgcttgccatttagcatttcacagagggaagtaagaggccctagttctgccacatggcctaaagaaagctcctaattttttaaacaaagaagctgcattttaagaggggatgttttcgagcatttgtcaaattttgataaactttaatttggtcactgttttgcttttgatccttgtctaagtatagccctcatggaagggaaccaaagaagagaggaggtgcaattggaaccattctgttgggttggtgcaaaagtaattgcggtttttgccattgcttttaatggcaaaaaccgcaattacttttgcaccaacctaatagtcccctaaacttactctggcctactcaagggtattctcaaacccataatctagtataggccaaactactgggctgctttctgtagcccttctcattgacttacttggtcgttgtctagtaagttaccataatgataacttatagctgatgttattgaatcactgcaaacattctctggaccaccaagctctaactagcaaagaaagaggttttgttaatctctacatttgccccttccccaaaaataaaaataaataaaaagtagccatgtaatgtcatagcgaattcatttgagcacagaagtaataagttcaattttataaaggttggtgcaaaaataattgtggttgaaagtaatggcaaaaccaattacttttgcaccagcctaatatgagtcaagcttcataagagttattggccatctgaagagctgtgttgagaaggaatctgataccataccaaagatcaatgtgaaatcatgatttgattaattaaatatgctatgaatatgagagaggggaaacgttatcatgagtgccaaatatttgttatttcatgcctagaatacaagcttccatggatgcatcagaaatgtggccaacacctacacatgttcagaaataaagtgtattttctttattacttaaaatatagcatgatcatatgtcacttttccccatggtggatggatttacacttgtagatattggttgacagcacctcatttcactctcaaatttgtcccagtttggacagtatgtatgatggtcagcctatgagattagttctactacatcctaagtccgagacttaaaattatagagtggaaggtaagagcctttctaaattatagtaaccctcctagggctcaaataaaattgcctggccttgtcaaaagttgacaaaaaatcacattcattgatgttaaacgtagtatatacatatagagaataatacttctaaatttttcaccatatggctcaaaattctattacactgtatgtttctagaatgcagggtattatgattttggcatacaatctagcattagaacacaaatatctgcttctacagtcactatgtgtctgagaacacagcactaaatccctagcttgcacgtggaagtgttaaaatatctccagaaacttaggtaaacaacacgaaactcaaagtgtacacatgcacacatgcaaatgcatattctttaagtggaacatattaggtttagcatttatacatgaagcaatataactgatgcatatagtacctatttctgaaacaagttcagcaatgtctcctccaaccctccaactccatttttaagtcccagaataaatgcccttttatgtctcagcagaagcccagccaattctgcaaatggtcttggaaaattgccttcagaatggagtctctccagggaaggtttactgtagaaaaagcagagatacatggggattttcaagatccagaaaaaggcaaaggaggaggtagaaggtaacttgaagcagatggcatccatttctctttacccagtagttctattcattattaacagcaacagtttccacttgtgtggagaacaattttgtattgatccaatttaacttgctaaatccacaagcccagggtctatattccaggcagtccactgtggggaaattattcctgttgggaacaatgattttctattttggaaactgaattcaattgaatctgacccgacaaatatctgagggcttattatgtaacacctctctctctttatattttattgtgccctgaagaaatactaaaattaaccaagtggaaaactataaaataagacatggtaagtgccatgatcagagtaaataattaacaaattgctcagatgttaggaagactttattcaactgaagtaaccagcaaagaattcaagaaggaaataccattttaaattttcccaaatagatgggtagatttttaatgggaaacaagagggactaccattcttggaggaattcacccagcatatgaaaaggcacacagggagagacttcaagaggcttgtgtttggagagcaagattattttactagattaagattacataaagtaccaaaaaactatggcatgtttgataaatttcagttcaatctatttgtgaaataatttatccaaagctcatagaagatattattttatcaccctataatctaaatgcacaccaatgagaatttgaacaagttgacactaaaatattccaaataactctttgaagaaagagaaagcaaaaactggaaaataatgagagtgaggatgctaccaatctaaggttattatctgtaggtaaagctttcttatcaggcaacgtcacatcaatgtatggttttactgaacaagaaagaataaaaaatacctaagtatttatatcaagaagttagtattaagcacaacaaattaagcataaagaaaaaaggatgaagcatataaaagtagaaactaatgaattaaaataaaagcaaagcaaacataaatggtgggaagagaacaacataaatataaagacaaatagaactgatcagttatataacatcagatattagagtaaataaatgataagaatctgatgcatccattgaggcaaacaaatgttagtgtcaaagacaagaatatttttaataaaaaaaattaccaaaacatactcaagaaaaaatatagtctaaataaaccaataacctgagaaaatggcagagagctgggtgagagaatttagcaagggccattgtgttttccaatgagttattagaaattttagaaaaatacactttccatgagaaaataatagttacatgccatgaaatattatgcaatgcatcccagttaaattgagtcatctggaagaatccaaataaaattgaatccaacaaaaccaggtaagctttaacccagcaatacaatttactagaatataaaaaccaagctctctccagcatgcaaagatacagccagaaagtagctgtctacaagccaggaagagggtcctcaccagaacctgaccatgtcaacctccagaactatgagaaataaaagtctgttgtttaagaaaaaaaaaaaaaaacagacaacaaaaacaaaaaacaccagcaccaatagcaacaatcctatagctttagtatgatatatcagtaggccaaaagagaaaatattatatttattttagtggcagaaatgacactttatataattcaattaaaagttaatattactactataaccagaatttttttatgataaaagataacttttttaagcagcacaatctagcataaaagtagaaccattctttcaaagtcaggaacaaggtgagaaatgttgctttattattttttaagcttgtttgtaaagttctagcaagggcaataagataagaaacaaaataattaataataattaagaagacagttctatcactattcactgaggatatgattcagaaaatacagaatcttaaaaaatgtttaaatttatgaaaaatataaattacctaaatatactaagaaagcctaaatatgaaaaagaaatataaataacccaatataaaatcaaatactttatttagtcaaaaacaagaaataatacaatgaaaatattaattataagggcaattatctgtatgttcatgaaattacacactaacttcataaataaaacctattaagtccaaactaataatacaatataattaaagtcctgattaacaaggctaaggtggggtttgagatcactgagattttaaagtaaacaactttttcctattcaagagaaagatcatttgtttattaacgtcagattctataaaattaaaatgtatgctatgatacttaatataaagaataaaagaatagaataggaaatatagcttctaaactagagcaatgtacattttacttctagtaaagtcttgataacacctatcagaccaatcctcccacagattacgactataattcctggtgtgttaatcggttttcacactgctataaagcagtgtgaaacactacctagactgtgtaatttataaacgaaagaggtttaattgactcacagttctgcatggctgaggaggtctcaggaaacttataattatggcagaaggcaaaggggaagcaaggtacatcttacatggcagcaggagagggagagaaagcaaagggggatctcccaaaaacttttaaagccattagttcttatgagaactctctcactatcacaggaacagcatggggtaaagcgcccccatgatccaatcacctaccaccaggtccctccctcgatacctcaacacgtgaggattacaatttgagatgagatttgggtggggacacagagccaaaccatataatctggacaaaaattaagccagccagtcagtaagcaaataaataagcaaaaaaactatctgaaagcattgaagaggactaaaagcaagcagatactgaagcttagctgacattttaaagaatcaaagagcatgggtgagttttcccttttaagagcttttctttgttggcagaattcaatctgaattgtgctatagggctacagctctttatggaaaacctaaagtcctactttcttgacaaaccagagaacaggtcactgggtgatatggtttggctctgtgtccccactcaaatctcatcttgaattgtaatccccacatgtcagaggagagacctggtgggaggtgattggatcatgggggtgggtttttctgatgctgtcctggtgctagtgagtgagttcccatgagatctgctggtttaaaagtgtggcactttcccctttctctctctcttgctgctgtgtaagacttgacttgctttcccttctgccatgattgtaagtttcctgaggtctccctagccatgtggaactgtgagtcaattaaacctcttctgtttataaattacccagtctcaggtagttctttatagcagtataaaaatggactaatacagaaaaatggtagtgggagtttggggcactgctataaatttacctgaaaatgtgaaaatgattttggaactgggtaatgagcagaggctggagcagtttggagggatcaggagaagataagaatatatgggaaagtttggaattttctagaggcttgttgaatggttttgaccaaaatgctaatagtgatatggacaataaagtccaggctgagattgtctcacatgtagatgaggaacttattgagaactggagtaaagttactcttgctatgctttaggaaagagactggtggcaatttgtccctgccctagagatctgtggaactttgaacttgagagagattatttaggctctctgggagaggaaatttctaagcagcaaagcattcaagaagtgacatgggctggatgcagtggctcaggtctgtaatcccagcacttcaggaggctgagtcaggtggatcacctgaggtcaggaattagagaccagcctggccaacatgatgaaacctcatctctactaaaaacacaaaaattagctgggcatggtggtgggcacctgtttcagctactcgggaggctgaggcaggagaatggcttgaacccaggaggcggagattgcactgagccaagatcatgccattgcactccagcctgggcaacaaaagcaaaactccatctttaaaaaagaaaaaaaacaaagaagaagaagtgacctggctttttgtgaaagcatacattcatgtgttcacaaagagatggtctgaaattggaacttatgtttaaaagggaaggagaaagcagagcataaaaatttggaaagtttgcagcctgaccatatggtatgatatggtttggctttgtccccacccaaatctaatcttgaattcccacatgtcgtgggaggtacctggtgggagataattgaatcatgagagtgtgtctttcccatgctgttctcatgatagtgaatgggtcttatgcgatctgatggtattataacggggagttccctggcacaagctctttttctttgcctactgccatccatgtaagacatgacttgcttctctttgccttctaccaggattgtgaggcctccccagccacatggaactgtaagtccaataaacctcttccttttgtaaattactcagactaaggtgtgtttttatcagcagtgtgaaaacagactaatacaggtagaaaacaaaaactcattttccagggaagaattcaagcccaagcaggctgcagaaatttgcataagtaacaaggacaagaagccaaatgttaatagccaagacaatggggaaaatgtctccatggcattccagaaatctttatggcagccccttcatatcacagacccagaggtctaggagggaaaaatagtttcatgggcttagcccagggcccagatgctctgctcagtctcaggatacagtttgctgtgccccagccacttcagctccagccatggccagagggaataaggtacaacttgggccgtggcttcagagggtgcaagacccatgccttggtgacttccataagcaattgggcctgcaggtgtgcagaagacaagagttgagctttgggagcctccatctagatttcagaggatgtattgaaacaccaggatgtctaggcagaagtctgttgcaggtggggagccctaatggagaacctataataggggagtgcagaggggaaatgtggaattggagctcccacaaagagtccccactggggcactgcctagtggaactatgagaagagggtcaccatcttccagaccccagaatggtagatacactgacagcttgcatcagacacctagaaaagccacaggcactcaatgacagcctgtgaaagcagcccagagggggctatactctgcagaggcacaggaacagagcttcccaaggccttgagagcccacctcttgcaccagcatgtcctggatgtgagacatgaagtgaaaggagattattttggagctttaagatttaatcactgccctgatgggtttcatatttgtatggggcctgtagcccctttgttttggtcaatttctcccatttggaacaggagcatttacccaatgcctgtgcccccactgtatcttggaagtaccaagtgcttttaattttataggcacataggtggaagggaatcaccttgtctcagatgagactttggacttggacttttgagttaatgctggaagaagttaagactttgggggactgttgggaaagcatgattcatttttaaatgtgagaatgacataatatttggaaggggctgggcagaattatatggtttggctctgtgtctccacccaaatttcatcttgagttgcaatccacatgtgtcaaggaagagacctgtggggaggtgattgaaccatgggggtggattttccccaacctgttctcataatagtggctgagttatcatgagatctgacagtctaaaagtgtggcacatcctctcttgctttctctcttgccaacatataagacatgccttgtttccccgtcagccatgattgtaagtttcctgaggcctccccagtcatgcaaaactgtgagttaattaaacctcttttctttataacttacccactctcaggtagttctttatagcagactaaatacagactaatccatggggaaactggaaagcaaggaaggaaaacctcagaaaataggaaagattttaaagcagctattctaactatgcccaaagacataaagtaaagtatgctcataataaataaagagatagggagtctcagcaaatgagtaaaaattacttaaaaaagggaattctacaatggaacattacactacctaaaataaactattggagaatgaggaaatggaaatagaaaaagacaaaacaaaaattaattcattacaaaagtcaaaaaggaaaagaaattaaaaagaataagcagaacaaatagcagtcatagcaaaagattaaaaaataaatcaaattgaagccacaaatgtaaaaggaggaaactctccatataaaacatgacaattatcaggcttgaataggtagatagaaagatagatagatagatagatagatagatagatagatagatagatatagatgaaatagatagatagatagatagatagatatagatgaaataaagacacacaactgaatccaattgtatgaaaatcaattgaatactggatttgaaaagcatagtatctactggaacatttttggaacaattggggaaataaaacatggacagaatgttagataatattgctgaatagatgttaaaaggtctaggtataataaaacgtaaaagatttatatgatctgaaaagaaaccagagtatagtctagatattacaattacattgtgattatggaagagagtgactttattcttaggataaacctgtggaagtatttagggaaaaagttaagttatgctttcagcttacctctaaatgattcaacagataaaaatgtaccatatttggaaagacagtgaaacagagaaggtgggggagagaaaacaaatgtgacaaaatgataataaatggtaaatctaagtgttggatttatttgtattatttcagtttttctggttgtttgaaaatatttaatataaagtattgagaaaagtaaatacatgttagtaaaaagaagcaagataataaaacctttaaaacatcattgaaaaatattcatgtatatgctcatgtgggggtctatgctattcccaagagatccagataaacttcctaaaatttctaccacctaaccctttttttttgtttgttttgttttgttttattttgttttttgacagggtcttgctctgtcacccagtctggagtgcagttgcccaatcttgctgatcttggttcactgcaacacttacccctcaggttcaagtgatgctcccacctcagcctcccaagtagctgggactacagcacacaccatcatgccctactaacttttgtatttttagtagagacagggttccaccatgttgtccaggctggtatcagactcttgagctcaagtaatccacccaacttggtctcccaaagtgctgggattacaagcatgaaccacaatgcccagcctaacccaattctaaaataagactttaggagagtgaatttattaccactgaactgtacaattagaagtggtaaagatggtaaattatgtatgcatattttacctcaataaaaataaattttgttttattttaaataaaaacaaatttaaaagagcgtaaagaaatttaaaaaaagattactcatatcttactttcatctgatttaggatttactcttgaacaaaactagttatgagttaactatatcatgatattgaccagttctagttgtgaagtgatttttatgttgattcgaaatctatctcaccattttttcccactcttattatgtgacctttgacacatcactatcttttggtatctgcagaacttaagtagttaagtaacagaaaatccaactcaaaataatttaacctaaaaaggaaatatgttggttgttgaacaaagtattttaagattagtgaatcatatatggctgtatccaagaactcaaatgatatcatttgatttcagtttctctttagtctcagctttcctctcttttggcatcctattgatggtaagatgtctatcatcctcttccaattcacattctctcagctaccccaaggtgaaaataagttatcttttatcgaatttccaacagaagttccaaaaacttgtcttatttacacacaacaaaaagatttatgctcattttacaaggacacaaagcagccaagtggaaggtgtgcttcctaaaacatgttatgggaggagggaggcagagcaacatggtggaatagaaggctcccctaattgtccccctcacaaggacaccaatttaacaactatctacacaagaaaaacaccttcatcaggtgagcactcacagtacctcgttttaacttcatatcgctgaaagacacaatgaagagatagaaaagcagtcttgaatcacccaccacacataccctacttcacctacagtggtagcatggtgcaaagtgtgtttttttgtgctgtcaaagggacagagcagcaattagcaggcactgaactcagggctgtcctgttatatagcagaaaggaaaaccagaccagactcagctcatgtcctcccctggagggagcacttaaaccagccctagccagaaaggaatcaccagttgcagtggtcagaacttgagttcctataaacctcaccactgcaggctaaggtgctatggggccctagtaaacttgaaaggcagtctaggtcacaaagactgcaacttttacccaagtcttagtgctgaactgggcccagaaacagtgaactagtggggcacatgagctaacaagacaccagctggggcttcagaaggagtgctaacatgaaccctcccctaactccaggctgcacagctcatggctccaaatgagacctattcattccacttgaggagaggagagggtagagtggggagaactttgtcttcatcctggataccagctcaaccacaacaggatagggcacaggttaaagttgtaaagccctctttccatgtcctagcccccagaggacatttctaggcacactctgtgccagaaggcaacccactaccttgaaaggaaggacccagaattggaagaatttatcacctgctaactgaagggcccctggtccctgaaaaaccagcagtgatacacaggtactatgttgagggccttgggtgaggctctgagaattgctggcttcaggtgagactcaaaatattcccatctttggtgactatgggttttcagaaaaacagagggcaaagtaaaggggactttgccttgcacttaggtactagctcagccacaggagagtagagcaccaagtgggttctgagagtactcaattccagaatttggctcttggacagcacttttgaacctaccatgggtcagaggggagcccactgccctgaaaggtgagtctcaggccagcaagcattttccacaagttgatgcaagagcccttaggccttcagggaacatcagcagtagtctggcagtactccccatggacctgtggtggtgatagcaatacgatgaggctcctttgccttctaaaggagacaggagagttggaagaaatgcatcttttggtttgagtgccagctaaactgcagcacaaaacaataccaagtagacatctaaggtttttgaatctagtccctggctcccaggtgacacttctggactcacgaggggacaagggtaactccttgccctgaaaggaagaatacaagactggctgacttcaccacctgctgattgtagacctccgggaccttgagcaaacataggcagtagcaggaatcggttaccacaggccttgggcaacacccagtgctgtacaggattcaggtctgaccaagtacagtcatagtgctggtggccacaggggggcttgtgtcactccaccccccagttttaagtggattagaaaagaaagagagagagaccctgttcatttgggagaaagtaaggaaagagaacaagattctctgcctgataattcagagaattcttctagatcttgtccaagaccatcaaggcagctcctgtacaagtgtgtaacaatcacagtattactgggcttggggtaccccctaaagcagacgcaactcagatcacaacagtcaagtaatttcaaatgtctaaaaagcttcaccaacagagacggctacaaataagcccagacagtgaagactaatataaatatcaactcctcaatgcccagatacagatgaacatctacaagtataaaggcattccaggaaaaagatgacctcacaaaatgaactaaataaagcaccaaggacaaatcctggagaaactgagatatttgacctttcagagagagaattccaaatagctgttttgaggaaactcaaagaaattcaatataacacagagaaggaattcagaattcaattaaataaatgtaacaaacagattgaaataattttaaaaaatcaagcagaaattctggagctgaaaagcacaattggcatactgaagaatacattaaagtcttctaatagcagaactgatcaaacagaagaaagaatccatgagctattagtgagtttaagataagctagttgaaatgacagagaagacaaaatagaaaagaataaaaataatgaagcatgcctacaaaaactagaaaaatagcctcaaaagggcaaatctaacagttattagccttaaagagatggtagagaaacagataggggtagaaagatcattcaaagaagtaataacagggaacttcccaaaccccaatatcttatactttgatatatcaatatccaactacaagaaagttatatagcatgaaggagatttaacccaaagaagaaatacctgaagaaatacctgagaagcatttaataactaaaccaccaaagatcaagaataaataaaaaatcctaaaagcagcaaaataacataaacaaataacatacaatggagctccaataatttggcagcagacttttcagtggaaacctgacaggccaggagacagtggcatgacatatttaaagggctgaaggaaaacgttttttaccctagaatagtatatctggcaaaaatatccttcaaacatgaagaagaaataaagactttcccagacaaagaaaggctgagggatttcattaacactaaacctgtcctacaagaaatgctaagggggtacttcaatcaggaagaaagggacgttaaagagatataagaaatcatatgaaggtacaaaactcacttgtagtaagtactcagaaaaaacacaaaatattataatactgtaactgtggtgtgtaaactactcttatcctaagtaaaaagactaaatgatgaacccattaaaaataataactgcggttgggtgtggtggctcacacctgtaatcccagcattttgggaggctaaggcaggcagatcacaagatcaggagttcgagatcagtctggccaacatggtgaaaccctgtctctactaaaaaaaatacaaaaattagcagggcatggtggtgtgtgcctgtaatcccagctactcgggaggctgaggcaggagaattgcttgaacctcgtaggcgaagtttgcagtgagccaagatcgtgccattgcactccagcctggggacagagcaagactccatctccaataataataataactacaagattttaatacatagtcaaataagatataaatagaataagtaaacaaaaagatacaaagcagtgggatgaagttaaggcatagtttttattagttttctttttgcttgcttgtttatgcaaacagtgttatgttgttatcagcttaaaataatggattttaagatagtatttgcaagcctcatggtaaccccaaaccaaaaaacaaacaacagataaacaagtaaaaagcaagaaaataaatcatatcaccagggagaatcaccttcactaaaggaagacagaaaggaaagaaagaaagaagagaagactacaaaacaaccagaaaacaaataacaaaatggcaggagtaagtcctcatttatcaataagaaagttgaatataaatggactaaactctccaatcaaaagacatagaatggctgaatggatcaaaaagaaaaagacccattgatctgttgcctacaagaaacatacattgcctaaaaagacacaaaagggctgaaaataaagggatggaaaaacatactccatgccaatggaaaccaaaaaatagcaggagtagctatacttatataagaccaaatatgtacccaacactggagcacccagatatataaaggaaatattattagagctaaaaagagagatagcacccaataaaataataactgaagacttcaacatcccactttcagcactggacaggatcttccacacagaatattgacaaagaaatgtgtgacttaatctgcactatagacccaatggatccaacagatatttacaaacatttcattcaacagctgcagaatacacattcttttccccagcacatggatcattctcaaggattgaccatatgttacttcacaaaataagtcttaaaacatttttaaaaattgaaataatgtcaagtaacttcttggatcacaatgaaacaaaaccagaaatcaataacgaggaatttgggaaactatgcaaataaataaaaattaaacaatatgctcctgaatgacatgtggttcaatgaggaaattaagaaggaaattgaaaattttcttgaaacaaatgataatggaaacacaacatgtcaaaccttatggaacacagcaaaaacaatactaagacagaagtttaaatctataagtgtctacaaaaaaaggagaaaatgttcaaataaataattgaatggtgcattttaaaggagaaaagcaagagcaaacaaacccaaaattagtagtagaaaaaaaagatcagagcagaaataaatgaatttgaaatgaagaaaacaatacacaagaccaatgaaacaaaaagtcagctttttgaaaatttaaacaaaattgacaaatctttagctagactaactaagaaaaaaagagagaagatccaaataaataaaagcacacatgaaaaaggagacattgcaactgatgctgcagaaattgaaaggattattagtggccacaatgagcaactatatgccaaaaaattggaaaatctagaaaaacagacaaattcctagacacatgcaacctaacatgattgtaccaggaagaaattcaaaacctgaacagaccaataacaaatagcaagattgaagccatagcaaaaagcctcccagaaaagaaaaactgaggacccagtagcttcagtgctgaattctaccaaacatttaaagaagaactaataccaatcccactcaaactattctaaaaaatagaggaggaggaaatacttccatatatattctacgaggccagtattactttgataccacaaccagacaaagacacatcaaaaaaagaaaactgcaagccaatatcactgatgaatataggtgcaaaattatcaacaaaatactagaaaaccaaattcaacaatacattagaaagatcattcatcatgtccaagtaagatttattcctgggatgcaaggatggttcaacatatgcaagtcaatcaatgttatacattgcatcaacacactgaagaacaaaaaccatacgatcatttcaattgatgctgaaaaagcatttgataaaattcaacatcttttaatgataaccctctcaaaaactggggatagaaagaatatatctctgtataataaaagccgtatatgacagatccacaactagtatcatactgaatgggaaaaaactgaaagcctttcctctaagatctggaacatgacaaggatgcctacttttaccactgttacccaacacagtactgaagtcctagctagagcaatcggacaaaagagagaaataaaggtcatccaaattggaatggaagaagtcaaattatccttgtttgcaggtgatataatcttaaatttgtgtgaccttaaaggcttcacacacacaaaataaaactactaaaactgataaaagaatttagtaaagttgccagatacaaaatcaacatacataaaacagcaacatttttatatgctaatagtgaacaatctgaaaaagaaataaaaagataatcccatttaaaatagccacaaataaaattaagtgctaggtattaacttaaccaaagaagtggaagatccctataataaaaactgtaaaatactgatgaggccgggcacagtggctcatgcctatattccccgcactttgggaggctgaggcaggtggatcatatgagatcaggagttcaagaccagtctggacaacatggtgaaaccccatctctactaaaaatataaaaattagccagacatggtgacaggagcctgtaatcccagttacttgggaggctgaggcaggagaatcacttgaaccctggaggcggaggttgccgttagctgataatgcgctattgcactccagcttgagcaacaagggtgaaattctgtctaaaaataaaaaaaccgatgaaagaaattgaagagaacaccaaaaaattaaaagatagtccatgtttatggattggtagtatctatctatctaatatatatataatttttttttgaaactgtgtctcactctgtcacccaggctggagtgcagtggcacaatctgctcactgctacctcgacttcctgggctcaagtgatcctcccacctaagcctcccaagtagctgggattacagtcatgtgccaccatgcctggataatttttgtatttttttgtagatacggggttttgccatgttgcccaggttggtctcaaactcctgggctcaaaaactgcccaccttagcctcccaaagtgttgagactacaggcatgagccaccatgcccaactcaatattgttaaaatgtccatgctacccaaggcaatctacagatttgaggcaatccctatcaaaatgttaatgacattctacacagaaatagaaaaaaaaaatcctaaaatttatatggaaccacaaagacccagaatagacaaagctatcttaaggaaaaagaacaaagccagagaaataacagtacctgacttcaagttatacttcagagctatagtaacaaaaacagcatggtactggcattaaaaacagacacatagaccaataaaacagaatagagcacccagaagcaaatccacacatctacagtgaactcatttttgacaacggtgccaagaatgtacactaggaaaaagtgtctcttcaataaatggtgctgtgaaaactggttatacatatgcagaagaataaaactagacccctatctcttgccatataaaaaaatcaaataaaaatggattaaagacttaaattttagaccccaaactatgaaactactgtaagaaaacgttggggaaactttttaggacattagcctgagctaaaatttttttagtaataccctgtgggtaatagtaataccctattaagttgcacaggaaacttaagcaaaaatgacaaatggaatcacatcaagttaaaaagcttctgcacagcaaaggatacaatccacaaagtgaagagatgacccacagaatgggagaaaatatttgcaaactatccatctgacaagggattaataaatagaatatataaggagctcaaacaactctatagaaaaaaaatctaataatcttatcaaaaatgggcaaaagatttgaatagacatttctcaaaagaagatacacaaatggaaaaccagcctatgaaaaggtgctcaacatcattgatcgtcagaaaaatgctaatcaaaactgcaatgagatatcatctcacctcagttaaaatggcttatatccaaaggagagtcaatagcaaatgcttccaaagatgtggagaaatggaaacccatgtacattgatggtgggaacgtaagttagtacaaccactatggagaagagtttgaagatttctcaaaacactaaaaatagagctaccatatgatccagcaatcccattgctaggtatattcccaaaagaaaagaaatcagtgtatcaaagagatatttgcactgccaagtttgttgtggcactattcacagtaaccaagatttggtagcaacctaagagtccatcaaccgatgaatggacaaataaaaagtggcacatatacacaatggagtactatttatccacaaaaaagaatgagatcctgccatttggaacacatagatggaaatagatatcattatgttaagtgaaataagccaagcacagaaagacaaacattgcatgttcttacttatttgtgggatttaaaagtcaaaacaattgaactaatggacatagaaagtagaagtatggttaccagaggctggggaaagtagtggagttggggtagaggggaatttgggatgattagggagttaaaaaaatataaaaagaatgagtaatacctactatacaatggcataacagggtgactatagtcaataacaagttaattgtacctttaaaaataattaaataagtatacttggattgtttgtaacacaatggatgaatgctcgaggggatggataccccattctccatgatatgattattatgctttgcatgcctgtatcaaaatgtttcatgtaccccataaatatataccccataatacatacacacaaaagttaaaaaaataaaacaaaataaatagaaaaattcgcaatcatagtttcagattttatcacccctttctcagtaattgatagcataattagactaaaattcagttaaattatagatttgaatgatactattgactcccttgattgaattggcataataactgctgaatacacatttttctccccaagtgtacatggaacattcatcaagatggctcatatgctgggtaaaataacaagtctcaataaatttcaaaagatccaaatattataaagtgttttctaaccaaaatggaattaaatttgaaattaataagctatttagatttttttttaaaaaaagaaatattacgggagaatgttcctgaaatctagcacatttcatactgaacagtaaaagactcacactccagggattcagtattttttctcttctgtcaattaaaggaatttgattgttaatttaaaaacccagtctttataagtatgtgattctgattttattgtaagtgtttgttcctggtggttttggttttggagcttgcatactcccacaccaagaccctaagagtggagctacaaaggatggagcctgtctccattcactttggaggcctgcagaaaaacccaacactgtttttttttttttccaagttggataaactcttaacgtttcacagtggggtgttgattttcctggccagcctgctgaactctggtaacacaagactgctggtccccagggaaccactatgcatagtatgcctaagatgtggcttggagctgcagaaacccaagtggggccttccgttttcagtaaagaccaggaaatctctgatggtgtcctacattcctctgcttaataccaatccctcctccccactaaagaccatgcaagtggttcatgtaaatcgccctggtctgcctgccaacattccaagtgcttcagaggaaatgtgaacactctgggtgcctaaattttctttgaaaggtcacgggcaaatgtgggctataaatgtcctggcattacagctggtctgctacccctgcttaggatacccagtactcaggctgctatactgaaaccttcatagatttagctttcctggatttacaattcaagccagatgcttatggtgtaagaaggagtggaaaggggtggtgagattttacatgtagggggaagataacgcagttgttaacaggtttgtcttttattctcaggagtgtagtctcatccctagtgcttattacatgccaggcactattctcaggaatgccctggtttgaaagataaattatatggttatcctagatataaagggcttatccaaagtagcacaggtaatcaacttcatattgcaaattcagatcacctaacttctctacagtgttcttttccctaagccataggcgcctctcatgaaaagtgctaccttcctctttctcttaaaagacctctctctctctacaaagacctgggacacacacttatcccttcctgcctctagcacagaaggtgaaaggctttctcagtttatttcattagcacctgagaaccattagttatgcttcaatggaagtatccgaactttagcacatgctaaattgaacttgatttttatctttcactgggaaatgttactgctttttgacaaaagaaggtaacttaatttctttgttggggacaaggggaaaattcaaaccttgtttttaggatctaacttcggcaaaatgtaaccagagtcttgcatatatgcatgcatgcacacacatacacaaacccctccttaatctgttttatctcaaccattgtgtacatagtggttgccagagatgaataactcattaatcttctttaagacaattagccagtaaattcaagctaattagctagatctgggttgagtcaagaaagctatttgttggaactggtagagaatttgtaggggcaaagttagaacaaggtaggaagaaagccaggatcagcagatgggagactccaagctctgcagggttgctacatagaattctcttcagaaatgccactggcctcaaggagcagcccaaaggtacaaggtactgcctcaaagatgtttgatttgcagaatactgtcaaattccatgtcttcattgtgccttctgtccttctggctttgaaggatagagagctggagtgagttcccaactatccccagctaggaaagaaggaagaaaatcaagcttcctcataaggaaagggaatttgagtgtctaatatgtactcttcactcattcatgttaagtagataacaaaacagagtcaaagaagacaggtgacaacccaagaccatccaagtagctagtatcagaagcaaaagactgcagccctgtactatgacatcccgttctccctgagagcatcctttaaagagtttgtggtgaatccaacctactaggacccagggagatcctagcgtgggaaggaaggagactcaagagcactgaattcagtgagctcttctgtttatcaataatatggctttgggcaagtcattccaattctctgagcctcatttttttcatttctatttgaggaaaatgatttctttgtcatagtcactgaaaacgttgggtaaaattatatgacgaaaacatccctagtgcttcttacatgccaggcactattctgtgggctttacatattataactcatgtgatcttcacaatatatctacaagctagctaccactaccatcatcaattaataaaggaggaaactgatgcatagggaggttaagttgagcagctagatagtgattcagagtggattcagacctggatggtctgatttgtgagcctgtgctttaattactttcctgccttttctaacttgcatactggcttaaatggagtttaataaatgctcctttaatgctgctgtttattcatccaatatatagaagctcaggacagaaaataggcaaaaatggcctgttagtatttatctctaacttgaactcaagatgaagagactgatccatgtatctttccccctgcccattacctgtttcaaaggatatagctgtcagtctttttcttggagatatagcatagagtttagcaaagacacagtgaaccaaagaaaatgcaaatctatcaaaatctcatagactccttttcatgtgtgttccaagcactaagagacacaagcatgcgataaggcctatctcaggcttgcaaacaataagagctcaaatcacacttattagaagaaattgaatttacatggccaactcaaaggggagcttgattctaggattacttcctttcaatgtctatttagaaaaaagtccccctttctccagatgctctcagaggaggggatgaaaaaatatctcctgttgggggatctcctgctactgactccatctccaaacatcaccctggaggttttgcaaattggcacagcacttatgaataatcagccacaaatgaagagtaaagacatgagctcttttttggaggaatttctttcctctagcttccagctgatcatttaagatggttcctggtccctcccacaaggtatgtcagcttacaagctcagccaatgtcctggacaaacaaaatctacttgaaacctcatcccagaaatcctgactttaagcctagctcgtcgtgagcattcctgctgcatggagataaatatgctctgtgtattatctcataagatcctcacaatgactttgtaaattcaggctggattattatctccatcttacagtaggaaaaaaatgaatggcaggatgattgagtaaatcactgcaggtgacatgcagtgtaaacagtgcaactgggttgtgagtttaggtcaatcccacacaatgcctctttctttaaatgagataaacccttgggtcaagcgctgtcatttccataaacttttatccaaatgtgaatgtctttgctgtaagacaaatcaggcaggggttattaatgtatcacattttcatcttccataatatattggattcagaaaaacttttacatcctaagttcttgttacactgttctggggtgcaaaatgagataggaatggaaaagtggacaacaaagaacagtgaagaaacttagaagtatcactgcatttccaattttgcctgagctagccctatcaaagccagtattcattattaaggaatcagagaggtgaaaagtatataaccaagatgaaagtggaggatttcaagggttaaagtctctatttactagtgaaggcaactactagccacttagaatttgggttattttgttgttgttattctgcatcctataaatgcagaatgaacatttatttgaagtgcaaatggaacatttaccaaaatggaccagctgctgggccataaaaaaagtctcaataaattgcaaactattgaaaccacatagagcatgttctctgactagagggattaagttagggatcaattaagcaaagaagataaataaaattcccaaaatgcttcaaaggaggcatttttaaaaatttaggtataatttacacaaaataaaatttactcttttcagtgtgcagtttgccagtgttggcaaatgcatacaagcatgtaatcaccagtatcatcaagatgtggaacagtttaatcccacacaaagttcccctatgtctcattatagacaactcctccctacgaccctagcctctggcaaccactgaactgatttctgtccctagaattttgcatttcaaatctggcttcttaaaatctcccataaggcatttgaggttcatctatgtgttgagtggatcagtagcatgtttcttcttattgctaaatagtattccattgtatggatgtgccacagtttatccatttacagattgaatgacatttggtttattcccagtataaggcaattataagtaaagtcaagataagtctttatacagagaatctctgggtctaagtgtatattcaacttaataggaaactgccaaagttttccatagtagctgtgatatcttgcattctcatcagcaatgtatgagggttcccattgcttgacatcctcatctgtgaagctcttcttagtttattaagtctttctaacaagtatgtagttgtatgattgtggttttaatttgcaattaaattactaatgatatttcatgtcattttgtcattggtatttatccattggtgaaatgtttattaagttcttttgtccatttttaaagtagactttttaattattaatttttgagagtcctttgtagagtgtagttatgagtccttcaggaaatatgttttttccaaatattttctcccagactgtgtcctgtctcgttttgttaatgaaaatgagcaaaactttaaattttatgaagtctactttatcatttttaatttttttatttgtttaatttttgtgttctatttcagaaatcactgtgtaccacaaggttgcaaagaatttcttttagttttcttcataatcttacaaaattatattccaaaattctcctttccatagtttatgcaattattgccatccattttacttctataaatgctatggacacctaacatcttgctattcctttttgctttagacagtcaattttcttttttgtgtgtgtgtggatcaaaatttctgtctagcatttcttgctgaagcgctttttagtatttcttgtggtgcagttcagccaataagagagtgtctcaatttttgtttgaaaaaaatatttcttctttatttttgaattttttgagtgtgggtctgggtgtaatagtctaggttgaaagtggttttgctttttttgtttgtttgtttgctttgctttcaggactttaaagatgtcacttgattttcttcttgcttgtgtagtttctgacaatatctgttttaattcttgtatatgttcctttgtatataccatatttttcctggtatctttaaatattttatctttatatatgattttcaaaatgtcgaatatgctggttgaagagtgtttgtgtgtgtgtgcacgcgcacgtgcactgtgtgcacaatatatgtgtttccttattgatcctgcctggtgtatggagtccccgggatttctgggctagtgtcatcttccacatttccaattacaccaattacatatacgtttgtaagatattttcccatggttcttggataatctgttctttttattttccactcttgtttctgtttttttatgtgtaaatttaaacaaactgttcaaaagctattttttatgtccattttcatttatatctaatttcatgtttataatttcttctaatttgtcttcaagttgactgaatttttccatggctgtatcgagtgtactaaaaaactcatgaaagatgttctttatctccgatcccatattttaaatttctagcatttatttgattctttttcacagtgtccatctctgtgttgaaatttctcatgtgttcatgcatgttgtccatgtttttgcactggaatctttgctgtgttgataatatttgttttatatttccagttgtttcattgtctggatgatattttagtctggttctcttgattgtctgtggaatgaagtcaattattacaagaatttcatggatgcagaaactgaggctcaaggaggttagatgagtactcaaaatcacggagccaagaactgatgaaatgaagtcaaacaaatttcaggctttatcttctgcccactaaactgtgctgctctataatatggacacaataaatagctactgaacaggtgattacatgacctggaattctcaagcataaaaatctgtccaatgttgcccaatagaaatgcctctggggacccaaatcttgggacacagctgagtgggaagccactaggagcttatacctatgttctgatggtgtagaactatttcaaaaccccatgagaatgtatgcatttggtaggtaagtgtcactgtggccaagtgaaaggtatgttcatctctttactcacttactcacctgcccaagcagcacaggatctggaacagtcagaggacgagactgcatggaaatatttgacataagccttatagacgcctctctcaccctaactcttcactgaaaaagcaccatttgttttttcaccgaataatcatttgtagcatacaaaatgagccatgtgatttgtttatttccttattaaaacaaacaaaaattcgccgccctgttctgtcccacagccagggctaccctggctataagccagctgtgtggctctgcaatttcaggcactggaatgagctgggatggggcctgcaggctttttctagctccaaaggcacagttgtctacagattcctcatggatcaggaaagctggggtggggctggcacacacagtcaatggtcttgtaaataaatgtgttcggcccattccagccagtagatagtgtatcacaaggcaaggccatttacatatggtcccctgggcctaggtcaggcattgaatcaggcatgttacctgccagacagctatagtgaagatagattagcctcctgggtgtcaggtatatgcatagcacatgaacttcccccaagaaagcaagttggcctctccagaagaccccctgggactgtgtctttgtggcctaaattccagcagggagcagccacagacctcagacttgcttcttcagtttagaagatattcttcaaggatggcttctggtatcagaggtctcaagtaagtgtgtgtaaaatatttcagtgttggacctaataaatattattcttaaggaaataattcaaaaaacgaatacataggcaaagatgttacttatagtaaactaagtttataacattaggatggtgacatatctatttaatagactgtcatgcagctattaataattttgccccatatttaaaactttagaaaaaaaagacactagaaggagtgaaaatatcaaagttataatagatgagaatttcccagagatataaaggtcacaagtattcctattgaaagggtatattaagagtttagagtaaaaggaaaggaagagccaaacctagggatattactgtaaaatttcaaggattaagaataaagaggagatccaaaaaccttgcaaggtgcagaatagtcacctacaaaagagtaagaattaatcggacctcaaattttccattagcaatattgtatgcttagggctactttatctttcagacattgagacacagtgcctggggcctatgagttttttaagttctatggaaatattttatagaagagaaactttattctagatatatattatatataataactatatatatttctatagatatataatgtatatgattgtgatagaatatatatacacacatatatacacacacacacatatgtaatatatattgttaatataaatttggtctttgttcgcagtttctgacacagagttacaaaaacccttgtaattttacaatagtattaccaagctaggcctgttctacccatcatgcagtatgacaatcactgagataatgagttttgcagtaaagatttttttcgctaggtagccagcaagcagatgggaaaccagatctcaaattcacctccctgaatatagggcttaggcgtatttacaggataaagaagcaagctggtcatggagaaaggtgattggcagtgggaaaaaatgaggtaatcagtggtttgtgcaagaatagacagagtttgtggcttttcataggacacatgtgcattcagaaaatggtggcatcagcataatctgagggaggaggtttgggccctctaacatcaaaacgtgacctctcaggtatttgcacctgcccagttgaagcgttagtggtctccactggtttaaactggactcgttcttgaaaaataactttaagcaatcattaactatagtgatatatatgtcagagatgttatctacaagaaagctagtaggagtatagttatatattgtttgactgtgttacttttagccacataggttttaagatcaactggaagtaaccaattaaaaccacacaagtggtttggtagacttaaccaggttagcctttagtttcaatagagtcatcttttgttctaatatttagtctttgtacctcattcctggcacataactcctaaaactcagaatctctggagtggtaagagtgtctttagtgtgctattgacatgactggtggcctctagagagcttcgggatgggggctggtggccagaaaaactaaggcatgattagagggttgggattttcagttccactctccaacctctggggataggactggagatttagataatcatcaattttcaataatttaatcagtcatgtttatataatgaagacttcttaaaactccctaaatgacagggttcagagagcttcccagttgatgaacgaatccacatgcagggagggtggcacaccccaactccacagtatagaatcccctgggctcaggacacttccagatatgaccctatatcctttataataaaccagtaaatataagtacagtgtttccctgagttttgtgaaccatcctagccaattatagaacctgaggtgaagtatggaaatccctggtttatagccaattgttcagaagtacagatggcgatctgagacttgcaactggtgtctgatgtgtttctgtctcacgggactgaaaccttaacctgtggggtccatgtcacctctgagtagttagtgtcagtgtggatttgaacggtagaataaccagctggtgttcagagattaggagaattcatttttggtgtggaaaaactcacatatttgatgctaaagtactgtgagtaaaaagagccaaatatataatatacagagatgctatatccatattacatgtgtgtatatgtatatagattgagattcaaaactataatactatactataaaatcaagtatgagaaattattaaatatgtatgtagataatattatactatgatactttgtagtatgtttcatatgagaggtgggactccaaaacttacagtaccttggattaacaaaaattccgaaagtcttgctagcaatctaattctaggccctaaaacctaacaattacaagggaagtatccctcccctctagatttgcaaacccaaccaaactatcaaccaaggcataaggatattatgaaaacatttttaggtgagacagaactcagacattttaagttaattttaagtttctgttagcatttgaatgctgataactaattacatttttcatctttctccaaagttagtagccagttaagaaatatatacaaaaagctgaatgatcaatttaaaagtgatctatgtcgttgacagtactgaactggacctatggccatttgggtcccttactaaaccctcgatggatcttaaatctggagtttaggatcaatcacctgagggattttaagggcagtcagtcggtctttccagaatcatcgctttgcctggatgcagtatagaaagggcctcgagctagacattaaaggaagacttggttcctgacccaggtgtgcttgctatttgaaatagatccagaatgccaacagctagggcaggcctccttgaaacagaaatcccagaaggggctgagccacatgttctttctacattattcaccataaaagtaagacttttttcactgggaacaagggaataaacaagagacaagccagaagaatttcctccattcatgttttctctttttcgcctagggcagtggtgctccaagtgttgtccttaaaccagcagcatcaacatcacctgggaacttggcaacaacaacaacaaaaaggaaattctggggcactagctgagcaacttagcaaattagaaactctaggaaaggaactcagtgatctgcgtttccataagccctgcaggtaattgtaatgcactattatggtggagaaccactgtcatagagcagtaatggaagtttatttccttttttggaaatttgaggctaaagaagattcccccacccaatcaccccttgagattgtatgcctgataaatgaagtcataaactgaacatgacatgaggtctattcaagagtagctccaacccagaagaggagtgtctggaagtgaaaggatagctcatgtgcagtgtgcctaggaaacaacctgcctagaattgactagatggatggtgggctcaagaaaggaggatttgatagaagagtcagtgtaattgagaaaagctaatggatctgcaataaagcacgagtcaggcacggtggctcacgcctgtaatcccagcactttgggagactgaggtgagcagatcacctgggctcaggagttcgagaccagcctggtcaacatggtgaaacctcatctctactaaaaatacaaaaattagctgggcgtggtggtgtgagcctgtaatcccagctactcgggaggctgaggaaggagaatctcttgaacccagaaggcaggggttgcagtgagctaagatcgcaccactgcactccagcctgggccacagagtgcgactccatcttaataataataataataataataataatacaaccggctgggcacggtggctcacacctgtaatcccagcactttgggaggctgaggtgggcagattacaaggtcaggagatcgagaccatcctggctaacatggtgaaaccccgtctctactaaaaatacaaaaaattagcagggtgtggtcgtgggcacctgtagtcctagctactagggaggctgaggcaggagaatggcgtgaacccaggaggcagagcttgcagtgagctgagattcgtgccactgcactccagcctgggcgacagagtgaggcgctggctcaaataataataataataatacaataaagtaccaaggaaataagaaggaagagaggaatggagagaggaagaagaaaagaaagatggaagagaaggaaggagagagggagacatggtgacagaaaagaaagatgaagaaagaaataatagataatcagcaactcaagaaaaagaaaaatacttcataaaaaacgaaatgagtcaaaattaaatatgacatggatttgagcaactagggccatatcaacaaaaaaggaaactctgtttcctctgaagtaccaccagagtggtgacattggaaccttagggatcacagtagttgtctttgtggtatcatcataataatacataacactggttgttgtttcccaacttttagaatcaatacacaggcaatgaacaaaaaactaaactgtggctacaaaacataaaaaagatgtagtcaatccgaaaggtgtacaaagtaaggtacaaccaacaaaggtttggaggtaggaggtatgaggtatgaggagcaaacacaatgggaagaatgggaatcctcacttcctcatcattcgacatagtaaacaattgtcaatacctgtgcagcaagagatagttttaggtaagcttctcaattttctaagtcaccagttggagaaaggtgatgcatgtgggcataggtgactctattagatgaagcagagcaagaaagaggaagtagtatactgccacgatgcatgcaaacttaacattatcaaggttaataagctggatatcaaggcttttgcacagattgatatatgttgctgggtaaaaacttacattgctttccatgggatttatatacaacagtgaattaactataaaggctaattcatttcgttgtgatgttttgagatgtcagcaatatcactttgttaatttccacaaagtcttccatatcttgaagcccggaagatagtgccctgagcttatgcattctttaacccaaacaatccatattagggacacatatggccttccagaggcactctatggtctttccacttttaatttttttagaaaaacaagatatcactctgttgcccagactatagtgcagtggcatgattgtagctcactgcagcctcaaactcctagattcaagtgatcctcccaccttagcctcccatgtagctgaaactataggtgcacatccaattaatttgtttatttttattggagacggggtctcactacatttccctggctggtcttgaactcctggcctcaaacaatcctcctgactcagcctctcaaagtgctccccacttttaatgatgtcttttggtggctgaagaaaaaagaagggaactttcttgtcagctttcataatacagtaatattacaccaagatctagtcccacccaccaaaagtagtctttgaatttcctcatgctgaattgactttacagtcttcctttttctccctaggtcttgaaggctcatgttaatagaaagcagtcctaagatgtgtattcaggattcaatttggtatttgctaggtaagaaatctgggcaagtttccttttgttttgtaataattccttttgatataatttttaacttgaccagattcaccctctttacttttcatttttgtttttgtaaccttttaagaaagagaaagccataccctgctttaggtatttgtttgagtttctaatgagtttgtagagatgaaaatactattcctattttaaagtcctgtgccaattccgggatgaaagatggagtcacagaaagggtatcttaagggaaatagtataataaaggcagtgaaaactacaagcaagagtgatatcatctcatgggtaaggctttgttacccatggaaggtgaaggacagcaagtgctgtactatgtgtcagcaccttagcatcatgggaaatgatcactttccaccgaggaagcagaaatggtggagtgtaagtgtggggatgccaatggcatagacagtgcttttcctaacaataaagggagagttaagagcccaaaatacttcactttgcaaaaatcagagtgcatgtgtcctggaggactggaatagagggggagctggttgaaaaatagaaaggaaactattaaaaatcgttgaattataacttaaagcgagccgatgtgatggtatgcaaattatatctcaatatggctgttcaaaacagggcagatgttgtgggtcaggaaaaccttgtataaaaaggtcaaggaattacaaatcttgggcaaacacttattgcataaaaataattgtatcaatagcttttttatttcactctaagtacatgtgctatatattttcatttgaaaaaaattaaaacttgcacttggaaaattatgcttcttttccaagaagctcttagctagcaactgtttgtgaggactttatcaagggaatcatcacgttttcatcattgaaaataacagaggccactgcatctcaaattattcccacaaatgggaacgaaaggcacttctctcctttagcatatggctaagttggcttccatcttctccatcttccagctaaagtgttatgtggcaaatggatattttctctaaaggtatcccaaagaaacctttccagggtaggcagctgcctcccatgcagcagaagcttatggaatagtgtaaattagggcatctccatgtcactagacctacagagtctatggaaggttgctaacttacctagtgaattccaagcatggaacaaacagttggaaagaaagagtctaaaagttcaaagaattgctgcttctctgatggcaagcaggcatgtgggaggctgggtcttggggtaaagagtcagagccacatttaggggaattgctgaaaacagattccaggagaaggtgtggcatggaacatcagatggctatttcacaaggcttttcaacctctggatcacaactgttctcttttttctttaattaggaaggattgtgtcctcagactttcttcagatagccccaaaaggccccatcctaggagtagaccagccttcctggctagcagaaatattactcaaaaagaaatgtaagtcatgacttccaggaacattgaggctcctacctcatttaccttaacccctatcgagtatgtttgccaggcttaaaagtatatattattattcaagtaatgcactattatattattttgtaaaaattcaaatatgtggaattttcagagtcaaaagtcaaatgtctttgacatctttgtcattccctttacctactctcctcatagtccccttcctagattcaggaataactagtatcaatttagtgtgtatcctcccgtacctttttctacgtttttagatacataaatattatatgcagaaatacagagttgtgttctgtatcttaacacagtaacagacactatgcattcttatgcaatttgcttttaaatgttaagtgttgcaatgttaaaagcaattattggctctctttgccctgtggcatacttatccgtaaaatgggaatgttataatttattttaccacttccttaatcacgtagattttgtttttcccccattttccattactataaacagctctgtaatgaaattttctatacttgcctttgagcatttttttagggaataaaatgtagattctgggttagagggtaagcacattatgcaatttaatagatattgtcaaaatgccatcctaaaaaactgtatcaaattatactcccaccacagtcttaacctattctaggaaaaccattttagaagataggaaattttagactcctgggtctaagttcttggcttcagaagcattgggccataggagctcagatatccatggaaaccttcttccaaggaggcaatgtttccagacccaccacactttacggtggtctgcaaagaccatgccaaggattgtgatttctcactaggactccagtgagggagtcagatccccacacctttttatgtactctttctaggtgaattataaccaaaatcaaaatttggactaaaatcagcctcctgtctttgttctgaaagtgtaagaaataaaacctgattttggaaaggaaaaagtgggtaaaaagaaaaaaaaaaacactgagaacaaatttcagcccatgtataggacagataaaaaaggtcaagtgattcatcttttttccctctacctaaattgctgcagcttcaatgcaacagaagtgactctggttgcaggaaccatcttcggttgggattaactgttttaggaatgcaagttagtatactggaattagaatgagcttgtctgggttcaagtccttgctctacatttattaccatatcagcttgaagaagccatactgttcttcttttccagctcggaaccttggattgttctcttcttggcacggaattctcttcttgcaaattttcctgaggctgactttctgttaccattcgagacccaaatcaaagttcttttcttccaaaaggctgttgctagaactattggaaaagagaatttatatttcagtttgctttcttgggcctatttatgctgccttaaagaaaagacaagcctgagcacaaagccagtacaaaatactgggagagccatatttttagtaatatcttctgagcatccatatcttaaaaagccttttgtctggcctatgtattctcacttactcttgaaggtagaacacatgcacacacacaaaaacacacacacaatcacacacatgtacacacacgtaccaattctatgtagcacaatggttttcaattttggctgctcattgatatcccctaggaagctttataaattctgatgcctgtgcctcacccccattgatactaattgaatttgtttgaggtgtgttgtaggcaacagaattttctgaagcaccccaggtgatcctatgaggtatgccaaggtagacagcaattggttcattggttcacaaactcttgtttccagataagcagcactggcatcaccagtgaagttgctatatttgcaaactcacaggctccactccagacttctggaattgaatagtccacagccagtatattttaacaaaccttccatgtgatgctgatggatgcttaggtttaagatcctctaatctagagaggtgatttggcaattttagccactacatggctttttgccattgtgagaaatttgctgctattagatgagaggtagatgaaactgcttgagtcctggccatgctttggagctagggagaggtagaagaggtgatgatgggtttcctgctgccttgacaagattagggagagtgatttaaacatgtctacttcagtgcaaggccagttcaataaaaaataaagtctcttctctaagagcaaagttggtatcacaacaaaggtggcaatagggcagcagagattagaagaggagtcattggcagcattggagaacgctagaggagttgcaccctctggggtataagatgtagagggttcttatggttcctgcagagggtgactccagaagggaccagtcaagctagagagaagtctacacaaccctattgccctctgctgggaaaaacaaagatttggtgtggatgtgagtcagggcatccagaaacgaggttttggcatcacagtgtgactcaccatatcttctttgccatttcttccaacagtcagagattcatgtgccaggtaagacacagcacattaaaggagaagcagcaggtcagtagaacaagtttaacctgttatattagtctgttcccacattgcaataaagaaatacccaagactgggtaatttataaagaaaagaggtttaattggctcacagttcttcaggctatacaggaagcatagcagcttctggggaggcctcaagaaactttcaatcatggtggaaggtgaaggggaagcagacacactttacatggtcagagaatatggaagtaggtgcggggactaacagattttatgctcacttactcactatacagtaccaagaagggatggtgctaaacaattcatgataactctacccccatgaccaaatcaccttccaacaggccctatctccaatattggggattataatttgagatcatattttggtggggaacacatattcaaaccaaatcattctgcccctggcacctaccaaatctcatgttcgtctcacatggcaaaatcccaccatgcattaccaatagtcccccaaattcttaactcattccagaattaactctaaagaccacagtccaaagtctcatctgagacaaggctagtcccttctgcttatgtgcctgtgaaataaaaaacaagtaagttacttgcaggatacaaggaagtacaggcattgggcaaatactccccttccaaaagggagaaattggcaaaaagaaaggggctacaggcctcatgtaactcaaaaacccagcagggcagtcactaaatcttaaagtttcaaaatgatctcctttgactccgtgtcccacatctttgcatgtgcactctcatgcaaagggtgggctcccaatttcttgagcagcatcacccctgtggttctgaagggctcaggtccccccagctgcttttaagggctgaagttgagtgcttgtggccaagtgcagagtgcaagctgtcagttgatctatcattctggggtctggaggatggtgaccctcttctcacagctccactagacagtgtcccagtagagactctgtgggagggctccagtcccacatttcccctttgcactgtcctagtagaggttctccatgaggactcctcctttgtatcagtcttttgtctagacatccaggcttttttatacatcctctgaaatctaagtagaggttcccaagcctcaactcttacactctgcatgccagcaggcttaacactacatggaaactgccaagggttatggattgcaacctctgaagtagtggcctgagctgtacctgggaccctttgaaccacagctggagctggaggagcaggggaacagtgtcctgaggctgtgcagggtgacaggtccttgggcctgatccacaaaaccattctcccctcctagggctccaggcctgtaatggaaggactactaagaaggtctctgaaatgcctttgaggcctttgcccattgtcttggctaccagcatttgccttctttttagttatgcaaatttctgcagcttgcttgaattcctcccctgaaaatgagcttttcttttctaccatattgcctggctgcaaattttgcaaacttttatcctcttcttcccttttaaatataagttccattttctggttatttatttgttcatgcatgtgagcataggcttttagaagcagccaggtcatatcttgaatgctttgctacttagaaatttcttctgcatgataccccaaaacatcactcttaagctcaagcttccacagatccctagagcaggggaactatgcagccaacttcttcactaacacaaacaaatgtgacctttgactatagtccagcactttgggaggctgagtgagcagatagcttgagctcaggagttagagactagcctgggccatatggtaaaactccatctctacaaaaaatacaaaaattagctgagcatgatggtgcatgcctgtagtcccagctacttggtaggctgaggtgggagaatcactgaatctgggaggtcaaggatgcagtgagctgagattgcaccacttcactctagcctgagtaacaaagagagacattgtcaaaaagaaagaaaggaagaaagaaagaaagagagagagcgagagaaagaaagaaagaaaaaagaaagagacatttgctctagtttccaataagtttctcatttccatgtgagacttcctaggctgagggcctagactttactatccatatcactatcagcattttggtcacaatcattcaacaagtctctaggaagttctaaactatccctaatcttcttgtcttcttctgagccctccaaaatgttccaatctctgctcattacacagtttcaaagttgcttccacattttcaggtatccttatagccatgccccactcctcagtaccaatgttctgtattagtccattctcacactgctataaggaaatacctgaaacttggtaacttataaagaagagaggtttatttggctcaagttccacaggctataatgaaagcatgattctggggaggccttaggaaagttataatcatggcagaaggtgaagagggggtcagcacttcacatggtcagtgtcaggcctctgagcccaagccaagccattgcatcccctgtgacttgcacgtatacgaccagatggcctgaagtaactcaagaatcacaaaagaagtgaaaaggccctgccctgccttaactgatgacattccaccattgtgatttgttcctaccccacattaactgagtgattaaccctgtgaatttccttctcctggctcagaagctcccccactgagcaccttgtgactcctgcccctgcccaccagagaacaatcccctttgactgtaattttccattaccttcccaaatcctataaaacggccccacccctatctcccttcgctgactctcttttcggactcagcccacctgcacccaggtgaaataaacagccatgttgctcacacaaagcctgtttggtggtctcttcacacggacacgcatgaaatttggtgccgtgactcagatcgggggacctcccttgggagatcaatcccctgtactcctgttctttgctccatgagaaagatccacctatcacctcaagtcctcagaccaaccagcacaaggaacatctcaccaattttaaatcaggtaagcggcctcttcttactctcttctccaacctctctcactgtccctcaaccactttctcctttccactcttcaatctctcccttctcttaatttcaattcctttcattttctgggagagacaaaggagacacgttttatccatggacccaaaactctggcgccagtcacggactgggaaggcagccttcccttggtgtttaatcattgcagggacgcctctctgattatacatccatgtttcaagggtgtcagaccacacagggatgcctgcctttgtccttcacccttagcggcaagtcccgcttttctggggaaggggcaagtacctcaaccccttctctccttgtctctaccccttctctgcttttctgggagaggggcaagtacccctcaaccccttctccttcacccttagcggcaagtcccgcttttctagggggcaagaacccccaatcccttatttccacaccccaacctcttatctctgtgccccaattccttatttccatgccccaaccctttctctgcttttctggagggcaagaaacctctaccccttctccgtgtctctactcttttctctgggcttgcctccttcgctatgggcaagcttccaccttccattcttccttcttctcccttaggctatatgctttttttttttttttttttttttttttgagacagagtctcactccttcgcccaggctggagtgcagtggcgtgatctcggctcactgcaagctccgcctcccaggttcatgccattctcctgcctcagcctcccgagtagctgggactacaggccccccccaccacgcccggctaattttttgtatttttagtagaaacggggtttcaccttcttaggcaggatggtcttgatttcatgacctggtgatccacccgcctcggcttcccaaagtgctgggattacaggcgtgagccaccatgcccggcctagcctatattcttaagaacttaaaacttcttcaactctcacctgacctaaaatctaagcatcttattttcttctgcaatgccgcttgaccccaatacaaactcgacagtagttccaaatagccagaaaatggcactttgaatttttccatcctgcaagatctaaataattcttgtagtaaaatgggcaaatggtgaggtgcctgacatccaggcattcttttacacatcagtcccttcctagtctctgtgcccagtgcaactcgtcccaaatcttccttctttccctccctcctgtcccctcagtcccaaccccaagcgtcgctgagtctttctaatcttcctttactacagacccatctgacctctcccctccttgccaggccaagctaggtcccaattcttcctcggcctccgctcctccaccctgtaatctttttatcacctcccctcctcacacctggtccagcttacagtttcgttgtgtgactagccctcccccacctgcccagcaatttactcttaaaaaggtggctggagccaaaggcatagtcaaggttaatgctgctttttctttatcccaaatcagaagcgtttaggctctttttcatcaaatataaaaacccagcccagttcatggctcgttcggcagcaaccctgagacgctttacagccctagaccctaaaaggtcaaaaggccatcttattctcaatatacattttattacccaatctgctcccgacattaaataaaactccaaaaattagaatctggccctcaaaccccacaagaggacttaattaacctcaccttcaaggtgtacaataataataaaaaaaaaaaagttgcaattccttgcctcctctgtgagacaaaccccagccacatctccagcacacaagaacttccaaacgcctgaaccgcaggagccaggcattcctccagaacctcctcccccaggagcttgctacacatgccggaaatctggccactgggccaaggaatgcccgcagcccgggattcctcctaagccgtgtcccatctgtgtgggaccccactgaaaattggactgttcaactcacctggcagccactcccagagcccctggaactctggcccaaggctctctgactgactccttcttggcttagcagctgaagactgatgctgcctgattgcctcggaagccccgtagaccatcacggacgccgagcttcaggtaactctcacagtggaaggtaagcctgtccccttcttaatcaatatggaggctacccactccacattaccttcttttcaagggcctgtttcccttgcctccataactgttgtgggtattgatagccaggcttctaaacctcttaaaactccccaactctggtgccaatttagacaatactcttttaagcactcctttttagttatccccacctgcccagttcccttattaggctgagacactttaactaaattatctgcttccctgactattcctggactacagctatatcttgttgccacccttcttcccaatccaaagcctcctttgcatcctcctcttgtatcccccaccttaacccacaagtataagatacctctactccctccttggcgacccttaccatctcattaaaacctaatcacctttaccccactcaacaccaatatcccatcccacagtgcgctttaaaaggattaaagcctgttatcactcgcctgctactacatggccttttaaagcttataaactctccttacaattcccccattttactgcccaaaaaccagacaagccttacaagttagtttgggatctgcgccttagcaaccaaattgttttgcctatccaccctgtggtgcccaacctgtacactcttttgtcctcaataccttcctccacaactcactattccgtgcttgatcttaaagatgcttttttcactactcccctgcaccccttgtcccagcctctttttgctttcacttagactgaccctgacacccattaggctcagcaaattacctaggccgtactgccgcaaggcttcatagacagcccccattacttcagtcaagcccaaatttcatcctcatctgttacctatcttgcataattctcataaaaacatacatgctttccctgctgatcatgtccgattaatctcccaaacctcaatcccttacaaaacaacaactcctttccttcctaggcatagttagcgctgtcagaattcttacacaacagccaggaccgcaccctgtagcctttctgtgcaaacaacttgaccttactgttttagcctggccctcatgtctgcgtgcagcggctgccgctgctttaatacttttagaggccctcaaaattacaaactatgctcaactcactctctacagttctcataacttccaaaatctattttcttcctcatatactttctgacgcatatattttctgctccccggctccttcagctgtactcactctttaagtcccacaattaccattgttcctggcctggacttcaatctggcctcccacattattcctgataccacacctgacccccatgactgtatctctctgatccacctgatattcaccccatttccccacatttccttcttccctgtttctcaccctgatcacacttgatttattgatggcagttccaccaggcctaatcaccatacaccagcaaaggcaggatatgctatagtacaagccactagccttcctcttagaaactttcatttcctttccatcatagaaatctatcctcaaggaaataacttctcagtgttccatctgctattctatctgctattctactactcctcaaggattattcaggccccctcccttccctacacatcaagctcgaggatttgccccagcccaggactgacaaattagctttactcaacatgccctgagtcacaaaaactaaaatacctcttagtctaagtagacactttcactagataggtagaggcctttcctacagggtctgagaaggccactgcagtcatttcttcccttctgtcagacataattcctcagtttagccttcccacctctatacagtctgataacagaccggcctttattagtcaaatcagccaagcattttttcaggctcttagtattcagtgacagacaaatggtctattagaaacacacctcaccaagctcagccaccaacttaaaaaggactggacaatacttttaccacttttgcttctcagaatttaggcctgtcctcagaatactataaggtacagcccatttgagctcctttttattaggccccagtctcattccagacaccagaccaacttggactgtgcccccaaaaaacttgtcatccctactatcttctgtctagtcatactcccattcaccgttctcaactactcatacatgccctgctcttgtttacactgccagtttacactgtttctccaagccatcacagccatctcctggtgctatccccaaactgccactcttaactcttgaagtaaataaataatctttgctggcaggactatgctgaatctccttaggcgctctctaatcagatgtcctaggtcctcccaattcttataccttttatacctgtttttctccttctcttattccatttagtttttcaattcatacaaaaccgtatccaggccatcaccaatcattctatacgacaaatgtttcttctaacatccccacaacatcaccccttaccacaagatcttccttcagcttaatctctcccactctaggttcccacaccacccctaatcccgcttgaagcagcccggagaaacatcgcccattctctctccataccacccccaaaaattttcgccgccccaacacttcaacactatttttatttttcttattaatataagaagggaggaatgtcaggcctctgagcccaagccaagccattgcatcccctgtgacttgcacgtatacgaccagatggcctgaagtaactcaagaatcacaaaagaagtgaaaaggccctgccctgccttaactgatgacattccaccattttgatttgttcccgccccaccttaactgagtgattaaccctgtgaatttccttctcctggctcagaagctcccccactgagcaccttgtgacccccgcccctgcctaccagagaacaactccctttgactgtaattttccattaccttcccaaatcctataaaacggccccacccctatctcccttcgctgactctcttttcggactcagcccacctgcacccaggtgaaataaacagccatgttgctcacacaaagcctgtttggtggtctcttcacacggacgcgcatgaaaatcagagcaggaggcagggatggggaggagctacacacatttaaacaaccagatctcaccacaactcacccactattatgagaacagaacgaagggaaaatttacccattgattcaatcaccacccaccaggcccaacctccaacactgaaaattacaatttgacatgagatttgggtggggacacagacccaaaccatatcacctgcagtgtcgagctgacctgaatttgaattccagttccaccactacctaactgtgaatatggccattttacagattatttcatctgtaaatggagggtaaaccatgttggtttgtgtaagaattaggaattgtgcttagcacagggcatagcagccattaggcggttctatattataattattactaatatttagccagttaattaacaaatattaggtgtttactccttgccagagtctggtgaaggccctaagaataaaataataaagaagaacagacacagctattttccttggaagctagtaggcatacagacagatattcatcaaataattattactcagataatcacacaaataatacacagtatatctataatatgtgatataaaatgtagagaccacaaaggtatgaatgtggatgacggggagtgtgttctaaactgggaggagggaggcaagtgtcacagatttcctgagaaggtgccatttaaactaatgcccaaaggataaatagacattgcataggcacggggaaagcaaatcaaaaagttttccaaataatggcaacagtttgtgcaaaagtcctatggcaaatggcaacatcaaggaacttaaaattatcagtgggtactgggctcagaaatcaaaagggagtagagcttcagatttggagaggaagaaaagtgacagaaatacaaaagtcatgcttttctctgttgttgtttttggtagcagtggtagtagtgtagtattccattccaaatttctgttcccactttaaggtattttatcatgattagtgtccagccacatataccatgaagacacactgagggccactaggctgccctggtcacaacctaagatcgtcctgtccatggctctgtgggaggctccgtttggatgtagagcaaaggagtggccccaatgtgagtggggtgtatagccatgaggacatacgcttttctcatttcgactctcttgtggttttgaatagcgtacttggtggttgaattaacaaagcactttgctactctctggctatggccatgttctggaaaactctcgatcaggtagcaaaatgaattcaacccttactgttttccatacaaagttctgaaggctttatgtattttgccactgattctcccagcattcacagtgactggttcaggctggcctgtgtttttcctagatcatctttattgccagtgtccgcagttgctggaagactttccaggatcctgcatgcatatggcttttgatggaaaaatgtctcccttggcatctccttgtaggagtcacatatatcaaaacccagctcccagaccacccttccagccaaacattcataaacgtccaggagggaaagaagttatgcaggaagactatatctcttaataaaatcttgagagagtttccatttcatttctaataaatcttctgtaagtgagtgttgtacaatactttcttaagaggcaaaattgcctccaaatcttttcctggatcaggactacagaatcatttgtacccgtctaacacatcataatctatctttggcttgacagtagtagacactattttttatttcatatagtatattattattcaagctcttttttaataagtaggttttcactgaatacaccttcttcttaataaaaaagtctaataaaatttagcataaatgtcattatttccccttttattaaaacttgttttaggagctctgctctatatttttgggctctaaaaaggggcagaaatttgagagagttggtatagcactgtgggttagaatgcaaactcaggattaaatagacctgggttccagtccaaacctttctgtgtaacctagagtgagtaactttacctctctgaacatgcttttgtttcctcatctatagaaaaggaataattagagacaattttaaggatttcaaaggaaactgaacctaaaagtttaatgcagtgcctgacacatcatctacactcattaaatttcattttattatttctttatcccatctaatctaataatagcctcaggtccttttatctaattatagtaatagctgccattttttgatcacatactatatgctgtgaattgccaagtgctttatgtgaattatctcattaaatattttcaataactctgtaaaataggtgttattatcattaccattttacagatgaggagattgagaggcaggcacattaagtcccttatgcaggattacatggctgtgagcagtagaattgtagtatcctctaatgcctgctctgagttgtggaaaatcagggctccagactacccaaaattcctttgttaaggatggagccgataggatctctttatgatgctctgtggtccttctcaaggacatgcagcacacctcagactttggaaggagggcttagccactagactggggctgtcctgggagggtcattttatgatccagtgaaatagtggaacgtgcctggaattctgactgcgtcagatctgcactcaaataggctgaagaggtgaatgaccttgttcaattattttaaatgttctgacagccagtttccttatttgtaaaatggagaaaggaatgctaactagctcacagagaccttctggggaagctgtactgcatcgtagtggttaggcacacaggttctagaatctgactgcctgaggtttatccacttcactatgtaactgaccatgagaaagttatttgatcttttagcctcagttccttcagctttattgtgactcttaccagcagtagagaactggtggcattgttataataacatcaacagaataaatatgactgaaatgagggtcaagaacatattttcactatttttcctatgtgaggaattcttcattatgccccagttgtatgttaccatttttaaggaatttgatataagtggagaaagtctatcattagttacactggtcctaaacaacaattattaagtgatccaaggctgccagcatcacacttggcaacatcagttacaatataggagtgccagggggcatagatgtacttgagctggcttttgatctcatgagtttctacacagccccccaagtgaaatgatttagaatcaaccggtaatactttcagagaaacaaaagccttgagtttattctctactcaatcagaagtctgcaaactctttctgtaaagaatctgatatgagttaggttcccattttagaaatgcttggtattggaagtgttttagatttcagattttttttcagattttggaacgtttgcattatccttactcattcagcatccctaatccaaaattctccaatgagcgtttcatttgagtgtcatgttggtgctcaagaagtttgatttcagagcattttggattttggattttcaaattagggatactcaacctgtagtcctatatttcaggcttcatggaataagagttaatgtcttcaactctttcaacaactgttctcactgaaggacaaacggtctttcttacattttacattagaaatgtaaaaagcattcttagctaatatagcctaacggaaacaggaagcaggctggatttggtccggcggttatggtttgtcagctcctgtcccagagtatggtggttaagagcgtggattctggagctgcaccatgtgagtctgtattcttgatttgtcactttgtagctggatgacctaggggaagttgtttaaactttccatcttcatttcctcatgtaaagcatgtaaagatgtcatgggagtgctgggggttaaatgagtaaacacatgtcaagcattcaaaatggagttttccatgcaataagtgctaagtgtttgtctttattattattatgttccaatttttcctgtttctcccagttttggaaaatacctgtagcatcagcccttttttacatcatagtgttctatttctctatagtccttccaacagattttctctataagtgctttcatgagtctcttgcatccaaatcatctagcgaacttgttaaaatgcaaattcctggactcctcccaagatttgctgtatcctgacttctagaggtgggccctgagaatgagcatttaatatactttactggtggttgctctgcacatgaattttagggtccactgcccctagagttccacatatcctccttcttataaagattcccggctggaagatagatgaaaaggaggggtacgaatcactgagttaaccctaagtctgatctaccagcaaccctgcctgagtgtcaaagcccagcagttaaaatacatgcttctaaatttcctccagtaccaggaggggaaggaagaagtactgattattgggaaaccaagcaccacccctatccagactgtgtggttggacacaggggagctaaatgaactcagttaaaccttgtggatttggaaatgagcacggaaagactgatcttatagtggcccaggcccccttccagagcagtagggcttgtgatacacaagaacacctctggacttcctctgaacttcactatgaaaagcgagaaccacagtatgcagctgctgggtacaaaactttcagggttttgcatttcctaagtgcaactattgtcatttgcttttcgatttatgcaatacttaatatttggggacatgttttttaaggtaaaaacttcaatgagtaccaattttgaaaggtaaaattttaaagtacttttctatcctcagtccctctcaccaaaagtaaccataattattattttcttctctgtccttctggaaatgtctcaagcatatgcaaaaaaacttatgggatgtagttgctagaaatacatattttttgcactaatatgatcatacaatatttattctaaggcgactagttcctttgacttaaactgtgtcctggaccaaatgatcacttttgattccaagtacctacttctatcacatttatcctttccgaatgcccacctccttcttccttccattctgtaatgtcattctttatgttacctagaaatttataatggatgttttattatcatcatcaaaataaggatgaacgcctgtagatagaagtattattcttaacagaccacagatgcatagacaaagctctccccccacttataaatgagtctgatgtttccttgggatctgtcagggaaacattattttccccttggtctagggacagcttctagcatagctgatgtagctaccaaacaaagaagggacactgtggcttcctaaagatatccatccccgggcaccatgctacctggggatctcctagctcacaattggaagttcctattgaagtttgaaaagctgttaggcaggatagccaagcattggtttgctcacaaaatctactctggcctagatgccactgttcatgttgggagtatcaggggaaacatctccagtgggcagtagtaggacttacagagtgctgaaaacaggtaagtggtgtctaggtgtgtaaggaaagagaagaggtagactgtttaccatagtccagtagcctgccacagtttgtcaaaagaatttgagaggctgagcgtggtggcttatgcctgtaatcccagcactttgggaggccgaggtgggcagatcacctgaggtcaggaattcgagaccagcctggccaacatggcaaagccttatctctactaaaagtacaaaaattagccaggtgtggtggcatgcgcctgtaatcccagctactcaggagactgaggcaggagaatcgcttgaaccagggagggggaggttgcagtgagctgagattgtgccactggactccagcctgggcgacaagagtgagactccacctcaaaaaaaaaaaaaaaattgacagtaggcaagtgaaatgaagcctcatgaacacttaataaaaagggaaccagcatgaggtcatcgagatgacgccatccctcagtaccctcaataaccacatttcctttcttggtgcagttgccagactagaaaaccaggatagtaccataaacatagaggatcagaaattcagaaacaggttttacaaaagtctcttacgagtgcaggatggtattttatttggttgagctcactcttagaggatgccagcaaatatgtgaatgtctgactggccatggatcactggcagtgcacctaaagattcactttgatacttgcagaaccttatagatggcataccttcagggacaggatggctgagaattctagttctggagaaatgcaaaagtcccaagtagcctgggacaatgggctactcattacgagacctgtgcattggagctgatatggacgagcaaaaacaagcaaggttcattatcaattaggggaagacatgaaaggtggtgagagacctaggaaaaaagaaagaagtgattccttttgtgctgggcaggtagtgtggcagagaccatttccatcagagtctttgatctcctagggatatcagtttgtgatgagcttcatggggaagaaaggaaaaactctaatactgtagaagtaacccttcagtgttttttaggaatagagtctgcccaagagcaaggagcaaataatgagagtcctcatgaattttcaaagtcctttttaaagagtagttcagacaacaggaccctgaaggccaagtgagaccttggtagcctctggactcttgacgtttttcctctcttgaaataatcatccctgagtgaataagaatcggtgacagaggcattcattcaacccaccgttgccaaatatctgtctaccctgcacctagcctgtaactagtgctgggcaaatagaaatgcgtaagaaacaccgctcctcaggccgggcacggtatctcatgcctgtaatcccggcactttggcaggccgaggcgggcaggtcacaaggtcaaaagatcgagaccattctggttaacatggtgaaacagcatctctactaaaaatacaaaaaattagctgggcatggtggcacgtgcctgtagtcccagctactcgggaggctgaagcaagagaatcacttgaacctggaggcagatgttgcagtgagttgagatcgcgccaccgctctccagcctgggcaacagagtgagactgcgtctcaaaaaaaaaaaaaaaaaaaaaaaaaagtaaaaagaaaaaagaaacgccgcttctctttaaggatctcacagccaagacaatgtttcccaagcaatggtgcccagattacctaatcagaatcacctagatgctgtgtcaaaaatgaagatttctggaacacagcctgtatttgctaaatctacatgttaacgattccctcagttatggatgtgaacagaaaactgctctgaaggaggcagataggaatctatctctgagtatgagagtgagtacatgtatggggtgatgggtgaaggcatgcgtgtatatattgtaaggtggtgaggacatgctaagagtatacgcatgagcatgtatgaatgcctgtgctgagggaaagtgcatgctgcattaagaagctatacaaagtgttcagttacttaatcagaagagaacaaaggcccatagaccaagtttctgaaactttaaaaggctcataccccatccagagtaagcttaaggatcagaggtgagaaactaccatcctcatagtttagtctgcagtccatgggatacagaaaaagcaaacatttttgagactgtctatgtctaatagcaacagcagtttttgaagtcacacagatctggacttgcatccggactgtgtcacttaccacttgtgtgatcttgatcaagaagctcatacactgaaccctaatgcccctgtctgaagaataggggtggcagtgccaatccttcagggtattgtgatcctaacattgctatgtgtgatgcagccccaacaaccagacacataagatgtgggggagtggaaagtggtgtggctggaggtgtgaaatccaggaggtgagaggattaccctctaataaatacaactcttggggtcctgggaacaacctcatgaatttacagtgaagacagatacatctttcctctttcctctgatttttccttgatccttacaagaggtgctgaacttcctgttagcagacatgatcaagcagaaactgaaccatggagatgtgtcccccatccactagcaggactttgactttgggtgcctgtcttctctagcaccagaatcctgggattctgagtccctgggtttctccagcttcccagtgtcttatgtataggctgagtcgtgattacatgtttggctcccacggagagatcttgctcccacccgcttgcaccactaagactagctttttggagtcgatcagaggttgccaggagaaggtcatacattcaagaatagcgtttcacccagcttccctccccagtgaatgtgccacaccaggttggaagagacatggtctcactgcaggatctttcccaaatgcaccccagaacacgatggggcagcactcagctcaagttaccatgttccaacgacttcctacctaccaggctgccatatgttcaggatggttctattgccagatgtatgtcaaagttttcctttttaaaatgtaatttccaccagaatacactggcatcctacaatgctgcttcttggctgcagaagcagtttttctgccatttgggcctaaaatagaaaccacacgcaaccttgacagtaatcacgaccaaggagagagaacgcacatctatttatgtggcactgaaggtgagttcttcctttgtgctactgcactggggaccagatcaacagagctaggaatatcagctcaaactgatacaatcacaaatatacaagatataataaactactggatattacaggtaaagtttatttttgagttttaaagaatttgagatattcataaattagggttttgtgtaggggtgacatagtgtattcattctcttattctttattcctcactgttcatgtctagtggacggtgaggtctcggcatctcatgacttgatggatatgacagtatccaggcatgtgttcatgtgaatgaatgtgctgtgtaaatagtggaagaactctcaagaattttattcagcaaaatcatatttattccaaaatatgtttttggcatccagaaaccacttctgagaatggaaatcacattcatgttttaaaattgtactcactttcggctgggtgcactggctcacacctgtaatcccagcacttgggaggccgacgcgggtggatcacttgaggtcaggagtttgactcccggccaatatggtgaaatctgggccaacatggtgaaaccctgtctctactaaaaatacccaaattagccagacatggtggtgtgtgtctgtaatcccagctatttgggaggctgagatgggacaactgcttgaacccaggaggcagaggtggcagtgagccaagatcacaccactgcaccccagtctgggcaaccgagcgagactctgtcaaaaaaaaaaaaaatactcactttcatttgaagtgaataatcagcatttttgttttccttttcaaatcccagtagttaggatggtagccttgatggacttaataggtaacagtcaacacatccctgagaacaaggtgtccatctgttccagaatacaaatatccaccttcacctcactgcttctcaaacctggtctcttcaaggtggtcctttctttcttttctgctaccagggcaaggctgttgcatttcagggttgtttctttattacctggcttatttgttcaaatggggttggatggaaaaacatgctgcttgcttaaatctgcaagaaaaaaatactacagggctctctggggtagccactggaaaattcaccactctgagacttttattgatgacaaactcgagtatgtttaagaaagcacacacacctagcaacgatttggacatgaagataatgtcagccccatgcacgggtacactgtccctgccgagaatttcactggagactcatttgggggctctagggcagggtctggctgccagctggtgttgagatggagttttccccccagagtaatcaattatcatttcccaagacgagctcatggaatgctgccagcacagtgggttgaatagtctgggagctggaattctttcccagatgtaggggtcatcccatgtatgtgtggtaacgatgaaccagaaaggcacagagaaaacatagtgactattgaaagtaggtctcaagttaaaaaaaatgttataaaacaggtgacagcaatactacacataaatatttgtcagctgggtgatgcagaagtaatcagacagatttctagggaccagtagaagaaatggatcttaagtataatctgttctaattccacaattaatagacaacagctttgatggagaaacttttctgtgcaaaacaatatccaacagcagacagatatagcagtagtaatccaaactctttcctcacggagcttgaaggacttgatgaacattctaaggaaatacagcatattaacatataataataaaatgaggcaagatatgagtgcttacaatgggtcaggtacactgttagactttagacacacaatttcccttaagtatttcaaaaaagtacaaggtatacactattttaattcccactctatagataaataaaccaagtttcagagcagtgctggaactagatgaaacaagtaagacacttgacttgggtgcaaaattaaaggagacaccaaaacctcagtaatcaagatttttaaatatcagaatgaaaaagtattacaataaaatatcaaaattttaaatgaagacacaatcagtattgctgattttttttttccttttgtctcaggctccagtctagcttggtgaggtgctggttcagagcattgatgagaagacttcccaaagctcatccatcagtgtgtggtacactaatgcctaagagatttgattttatggcttgaactttcaatctgtgcactccaaccgaggaggacaagggtcaagccttgctgatgcaggttctgggaaggaggtgtcaggggaagcctctcttacccagatttgcaagtggattgaaaaaagagcagatgtgcaaagtcaggagaatagtggtggtgggccaagtcccataccctggtgagaaggatccagctgggcttgggagaagctgattgtgaaatactgacagcgaaaggctatcgtggggagcaagagaacagcagctgagtaggccagtgggagtcaggactggatacattcctgacttagaaaagggctttgataaactccaagaaaaatgatgtgcagatgagcacgccactctacaaaatggcccaaagatggagtagagaggcatctcaagccacagagccttggctcaaaatcactccagattggcagtctgtaaaaccaggatttggaacttaagaacacaccatactttcctgtctccagggaaaggatgattgccttatgcacttacataattctgctcacaccccttcccccacaaatatttggcccctggaatgggacagggcgagttgatagctccctggggacagggtggactctggcttatagacacagaaagatttatttctgctgaacctgtgacagcttggtaagagtatttcaataatttgagctgcttacctactgttccttttgtttttaacaggttcagtcattcactttgctcaatggattgggcttgtctttagaaaggggaatgttgtagctcagaagccagtgatgggctcagtaaggggcagcaggtagggagtgagggtaaaagatagaattccgatagaggaaatatggaatttcacttacaaactaatggaatgcaaacgttgttggaattccataccagagagcaccccagtgaatccttcccaaatgtcctgaccttacgcctgttgtggtaatagtcaggttaatgtaagagatgtttccccagatacccaggtaatctagaaaacatattctaatttcaagggggattcacctcacaggcctggagatatgagcctctagttttcttcttttcgcactagtctattgacctccacaaaataagtaactccaatgagaattattccctttcgtattatcagacttcagagccctcaatcccatatgaagcactggaggcctgtctctttccagctccacctcccacatgcaaaagcttaggcaaggggccagctaacctgcttggctattggcaccttgaaatggaagtaaatccctactcttctgatttattatttcctgttcttcgaagaggggggaaggcagcaagtcttgaagtatttaagcagttagtcactgtacaaatccatctcctgtctcacccccaattcaggggaataatatttttttccctgagttacataaggcatgatagaaagcatttcggaaccccgtctgcctcaggaccgatttcttgaggtaaatctctaggaaatctttcacagtttctaaaataagtgcccaggctttgaaaataggtcctacagcatgagcaagctctatgtcacccatgtgttaaccttagcatcacttcctctctttctatcatcactgtcttcagttccaatgcagtttcatccagatgacaggtgcagccgtgtgcatttttacaaatggagctatgtttcaatcctggagatttttgatattaagttccgtaagtcaaaactcaaaacaacatgggaaaaaagttaaatttaatgtaaactggacaattttacgattagctaaagtactgagctcattacaaactggaaattccctaacagacattgtcttcgctggacaaggtagctaataatgacattaatttcttggggttttgtctgtatttgtgtttgtgtgtgagtgtattttatcactaaatggctaagagttgcacatctgtaacttagtcctgcctatggttgtataatggagggagattttttttgtaagactaaggtgttatttcttcttgctataaatggctgatagatcttggcttttctcagatgttctaggtcaggaaccatagtccatcagcctgcaatagaagagacacctgaaactagacttgaatatcctcctctcggctccttcccttctctcaaaccatttggtactcacatctgactttaagtaaatgtatttcccattagctcatctcagcttagctttggtctctgaatctcaggacccaaagctatgatttccagctagtggctcatagctttaacttattttctaccctcaaccacttaatatgacctatttaaattgccatcttcgctgtctgcatgtggccttttcttagatctgcttcttgcttctgggaacaccaattcctatcacaaaagattcattcacccccaatctatgaccactcagttgataagtacccacatgtattaaataacatgagaaagtcttagagtggaccctactatatacatgcacacacacacacagactgatacttcatcatgaatggaacacatctggccagagattgactgagacatatttgcctttgtaaatctggacatgcagttcccaggtttgtgaatcaacatattttaatatccttctaataatactgatctaataagtatcctaacactcaattctaggcatgtggtctgggaccaatcaaattccaaaattattgagctcctattattttcatttgaacttcattcaagttcaagtcatctagaacctctctgtcttctgccctgaccttgaaataagtctcccaagagatggtggtcacctactacctggcctttaaccatgatagacggacagcttgggattccagatacttctgattattcatctgctagtggccttggctgcattgctggatggcccagacgctgtgtattaatttgactttctactgctattcttggaatttttatcagtgtggccctagccctgttgagaacctcattatcaagaagtggcttctcctgggcagctgaagggatatttattaatacatgttttgagccctgtaaggaagggagaaaaacaaagaagactatattggctattattttctaaccctcccttcctcctcttcctttcttatttcctttcccaattctctccttttattcaataaacatagcatgttaactacataatttgtaggaacttgcaaatatgattagaaagaattccacctccacataacttttgtttgctacacacacccaaatgaacacacacacacccacacacacacttagaatgagaaaagttgttaaaggatatataacattaaacatcaaaacgaatgatacaaacagaaaaagtggtgctaatagttgaaagaaagaaaagcaaaatagcatctaaatcgattaagagaaaaagttaacaaacctgcacattgtgcacattgtactctagaacttaaagtataataataaaaaatatatatataaaagttaataatataagtaatcatatccattagttattgagcatttctatatcttcataaggcaaagtgtctgtctagagcaatcactgcttaggtactttcagcttactaaatgatggctccctccatacccaatgatgtgtgtgcgtgtgtgtgtgtgtgtgtgtgtgtgtgtttgtatgcatgcacaaatgcctgttgggatttcctttaggatctctctaaaactcacatctctatgagataggaataattcttaatttaccaatgagaaaaccaaagcttacagaggttaaatgacttatataactagtcagtggcagaactgaatctgtctactctgaggctaatgtttcttaacacaagatttccacaagaaggtgaggtttaagtatgacctaaaaggatgtgcatgactttatagcagaagttagtggcagggtagaaggcagaaaaaccataggttggaatgtgaaattgagacaaagcatgtacagcagggtcaatgagaagccagagagaggggaaagaaggtaaaaggaaacaatgatcagtgagacatagagagtaagccagaagccatatgtggaaattcatgaatactggaaagaagactgtgagcttgaatcacaggcaataagagtcccagacagtgtatggtggacaagtaatcgaatggcctcagttttaagaaaattaattcacccagaaaatccagatgcattgtgatggagacagcacacacacacacatgaaaaatttagcaattgaagaataacatttattccaatgtgatccaatctccaccactccaaacatttagaaacaaagcacatgaccttaataacctgccgtgaaaaatcctgcctcacatgcatttgtaggaaaacctctttttctttcttcagtcatttgtcatcaaatcagtttcttacctccaattttaattactaatatatgtaatgccactcaaaagaaaaagagagacagacagatttatcaaagcaaaacagcagctcccttctgatctcacatcatttctaaggaatcaggagtcaatatggggtaagggaccctgtactaacagagtaaaacatgttcaaaacttcaccaacaacctctgagagaagatggagtttggtcaggagctgctaatggttgagatggcttagcatgtattacttgatggagagagtactggagagctttcaattaagctgctgcaaagctccctttctgctcaggctctttgacaggtcattgaatggggttttcaaggacaaagaatgagcgggcatgtccccatggaagccagtgcccctctcagaagtgttaattccagtgatttctcctggaaaaggaaatggagaagtcagggatggataagcctgctgactaatctataaaaccaatgccccaggactggcagaagttgaaatcatttacttataattagaggtgcaacagactgtgggacttgaaattttacgattcaacattcttggtgaaaatgctcaataataattaagaaaacaatcaaaatcttgggcaagaaatatgtgaattaatatcagatatcctcttctcaagcaagaccagcataggtcttctgataagtcaccactttgaaaactgaagttaaacataatcaaaatcttcccttcagcaccccaccatcactagggctgggattatgtaggacaaggggattttaggctatgaggggacatagaaaagaaggtcagatttctcaagacttcctgtcagggttgacctttaatgaatatgccccctgggattctagagtctggaaaagaatgtaatgactttatttacaacaataagaattagagaccaacaagtcaatgccattaggaagcatttttggatttttggtccaaaattttaattgaaaacaagaaagtatgcttataataagatgggaaaaattacaatacggatctcattatttcaactatagatgcaggtgaacaagactagtatggaatttgcaaagaaaaaggaaaataattaatttaggtttaagacgttacaaggaaatgttttgtccctggatcagtgtcattaagtattgctgttttactgactttacattttttaaagtggatcaaaaaccatcagttgtataaaattgaattattatcagtagaatggttttgagagagctgggtgtgatctttagctagttcccataacaaaaatatgttgcatagagtaaattaacatgtgcagaggaattagtatagtgtctggcacatagtggcccatcttgtaattttcattgccattattactaggtaataatgttctaatgttattagaacatgcacgttgtgatttgcccaactttgctactgctacatatgttaaaaatatatgaaggcatttgctgattgctgtgatgtctgctattctagagaggtccatcagagtccttccacctctaaagcaaggggacatttgcatccctcatttgatgtctcctgcaggggattttcctatgtcagaaaagtcctcagtgaaaggtccaaattcaccagtaaatatcttcccagcatttcaaaatatttcactctaaaggtcagatattaaacaaaattaaatattttgctctcttctaccctctctagaggccactgaagactgctggcaaccaggagtcagagcacattatctgttattagcacagagttagctgttgcttggggctgcgggagaggaggctgaagtctattcaattatgtgtaaagaagcgcaatcctggatatttccaagccctcccatcatttggacacatggtatttgggatgctgtaaatgtaaatgtaattctggtatcctatgaagaatctgggatgtaggcttcaaaatagatgtatcatcaatcttccattaattcaacataactatgttgatcattactgtattttactgaccttaagacacaattgttgtgtgtggttgtttcacatttaaacacctctaaatgtagatgtgcaaggaattcaggcagcaaatggatatgctttttattgcctgtgcataaccatcaaaattttcagagtgagcatcaggggcttgaaggaaaatcccagggaaaaaagttgagccctcttgcaaaaaaacgattcttcaccaatacacttgaaaggctatataggacaatattgtttggggacaaaacccggacaatggaaactctgagtcaaagaataatacaacaagattcagtttgaagtgttaaaattttaagacaccttaaccaatttactgtgtgttattatttgcctttttatatgtgtacaagtatgttacatggcaaaacctacatctaaataagactaaaagggcacttttaataaataaaaataatttagtaaataaaagttttagtttaaaaacaagaaaaactggttttagaatatagtttaacctattattctcctaaagaatatagtgtcttctcaggcttaaggataacacaagtcaatggtatgaaaaagacaatgtatatattacacttggctaattatctagtagacataaaactaatcaataaagtggtcttcctataaatacttctacacctgaacaaggatgactatgattcgaaggtccaatgagtcttctacctattttgaaagcagcaaccttctctcaaatgaattttggtgcaacacaatttgaaaatgccactaacaaaaattcactcaaaatacactcactcagaaaaaaaggtgtgaagggagtgcataagaaaaataccacatttattgaacatgtgctagatattgtactaggctttttgtgtgcattaactcattccatcctgacaagatatctatgaagcagatatcaatatccctaaattacagttttaaaaaatgaccagaagatttttctactcgcttcaagtcacacaactggtggagtacaaatatgagatttggataccaaacactatgtaccttaatatatattcttgatacagagtattgaattatcccttaatcaatctatgccaagaatcatcccatacacaaacacacaaactaaattgccagcctcataagctaagagcaagtaataaaatgtttatataagtcaaaagaaatattgagccaagtaatcagttatttcatcagagaatgcattaaaacctaaaatgattgatgatgatgtaaaagaaagtgatcagtggacctcgggatcttgacattgtgtgatacatgagccaaacttgttatggaaagtcctgaaattgtttaacctggtgtgagtgaggggtgggaggtcatgcttttcccattggtgacaaatttttccatttaacagagaaaaaaagacttccgtatatgttatattccattccccaaaatgagctcaagattcttggggaggaaaacacatttatagtgctgacttaacctcagtgagaatgcattattattataaggttcagcacttgacataggctttgtacagaatggctcacattttaaataccaggcacaattactgcatcatgagaagctgatctaaaccacaaattggggcataataggcaggagaaaaaggttgaacagacaaatcattcaataggtgattctgtttaaaaagaaatatttttaaaatgcccatctttgatggccaccaatgaggaaacattaaactagcaaaaagaaaatgactaatacacaaccaagagaagtgtatagtgaagctacatgtacatactttgtatagaagagaataaatcatactcttcataaatatttgcattagggtcgaaacctaaactttatagtcctaggctatccccaagtcaatatactacctctccagaatattgaagaatcttcatttaccaaagaacatagccagtaatttactgtgtattaatttacaatagaaataataaacttagtataataaactcagtcttagttcagatttgcatgaactgaaagagaaggtcaaatctatgggagagaaaagtcaagaaggatataggaagatatacataattgcagttagctggggaacaattcaataggcataggggaaagatttatgacaccaggatatcatcctatggtttcaggcctcaacaaacacatgcagattccctgggaaagagttagaaagaaccagagagagaagcaggaggaggttaagcaggtctggccccagaatctcagagggaaagtggaatgctgaccagaaaacatgtttggaagcccaattgcaaggtttaggtcaaaataagaggtgtcatagaaagggttagagatgagcccacatattggcacctgggacagaggcagcaagactctctctgaatccttatgtgcccttagcacaaaaaagagcacctcgttggtctgtagttgtagtaggggtctcagctgctccacatgagaaacctgttgttgggctgttctgaattcaattaccccagacatggccccttttatttctgtacctaccagaatttcaccttctgaattttttatcctctgtttatctctgttgtgttgaaggaagaccacacaattcaagaacacagtgggggattacctacaccgtgcgctttcaaggagaaaacagaattttttaccttaaagttcctaccaatgaatatactagcatctgggatttcctacctctttgggtattgttactttccaatgatctttttatcttttatctatctattgttcttcctacttttcttcctatcatatctatcttaactgaataatgtctaagaaagatgacctctttagccaacatatatgatgtttagcttccacggaaataatttatcacatgaggagaaatggaagacatgacaatggcatttttaaaatagaagaggaggcagtgtgaaggcatgagaattcagaatgaagggggggaagagaaagaaagagagagagagagagattgagagagagactgatatagtatttgggttattcagaggagttgcaggaatcgtgaaaaaatagtgctgtgcctgtccttttgggcatgactaccatttatcaagtgactattacattatgctgcaggcaccatgccaactgctgtatatgtagcatctcatggacaactctctcatgtatgtgtgcttttatcccttttaaagatgagcgattgaggatccaagagcttaacacaagttacgcagcgagaagtagaggtaaggttctaatcaagttctatagttctgttctctctgctccaaaaccctttctccttccgctattttggtctctctccaaaacatccccaaaggctcattctgcctcatgaaatcacagatgataactctacaaggaacttaaatgattcctgcagcccaatactcccattttacagacgggtcagggaagtaatgtgagatgctcactaaggccctcagcttgtcaaggaactaggtctactcacttcacttccacttaacattcttctaggtgcttactggatctcagaggaagagtcaagaccataacccagggacacttgcaatgcctacccaggtttttcatgtcacccttctactactgcatgcacagatgcagctgtcaactttaggaacactgctttcaaaccttttcgaagttatttttttaccatcttctttaatactatactcctttagagagaaatatcactttctaatactttttaaatttttctatttttatgaagtgttagataaatgttgaatgtatgcaaaacaaacacacagcaacaagaatagccaaagaaaccatttggcttgcttcttctgctgtcgtcttcttgcctttaagcttgtgttctccctaacttttaaactcaaaagaattttttgtcaacattaaaagttttctgataagtattctgaatatgtttactgaggaaaaatttaaataaaaatcattgttcagatgtcactcatatcaatcactctctgcaacagctgtacagtagaaataattgcaaactcatgccctgtactttaaggatgtgagaagaaaagaaaaacaaaatggattatttttaacaagactctgcaagtgtccagcatctccaaagactatcttctgcccatctatttttccagaaatattaatgactattcctccaacgttttccattacgtaacacccacatccctcataatcatcccctccttttattaccattagcattacccacacagttccacactcaactcatttttaccacctctattgttacaccagacacccaacctggcagaaggatcagaaggaaagttgacaagatagtaaaatcaacaaagtgcagacctgaatcacatcaatgccagtgagtaatgtggggctgacttgctgtgaccctgtgaaatttacaagtgtctatatgggtaggtgttcccagtaacatctacccacacagactttgcccatataaatgtgaggtctgctagaaaaaaaaattaacaaagggtaagaataaaataactaagtgagagatggatttcatgggactccgactgtaagtttttgtcccagattgagaaagctgacatttaaccatctagaagaatgcactcaaaatctttgttaacttttggaccttgtcacctacttagaactgtagaacttaaggctgcaaaaactatcttctcttaccactaagccgttttcttagtaagccttttaccaatgtaggaaagaaaagctaacatcttttctctatcatctccatctcctccatgcacccaggagcctcaggagcaccaggctcaaaacccttgtccttgttcaactacactctttccctgctagtggagaagcgctctgtgatacttcactaggaatttggaagagttaatattaaactttgcattgggggccatttttatattttattacactggctgtaaggtgatttcaataatctaagtctattgcttctctaacaggaacaagtaccagctagagatttttcacatacgtgtctaaatatagttttacaatacctcattttaagaatgtagaaattgctcagagagcttactaaggcttgtataaagttttttatcatccactttttgatgtttactgtagacacaaaattgtcccactcatacctctttaaggaaaggcttgctgtccagctgcagaaaatacagtcagtggaggtggacggcgtccagctgtctgcttcttcagagcctgcctcacctgaagcaaggcaccttgcctaaggtccctctttttgccaaggcagatacatgcagtaactgagcaaggttggaaaataaagttttgaccatttggatccacagtgttacactctcagggctggtactcactccagagctctctgctggattggcttggctttgtcaattctctctagtagtttgacttctccctctgtttatccttctcaacctcttttctttcataagtgttgatttctaataaacattttgtatcccaccctttatcttgatgtctgcttctggatgcaaactgctgataccaacacaaccattttactctttttctttactcagataaagcctagaatctataacgcagtgtggccctagcaaggaacatacaaacagtacacaggtgaattattattgcatccagcttcagctggtactactcaaaccccagtgtcccagatctctggacacaggcttctaccctagagagtacatgtctgctttcactcccaggtttttctctcaggttttcagtgactctgagctactgaattcccagcttctaaactcttgattttctcataaatgagtccccaatatctactcaatatgatatttataatgctcattacctgtttttcaggggtccccaaataaaatgtctgctggggattgtccaataaaataaattattaaagttgtttaggtataagacaagagaccccaacctgcttgtttcgcaattgagcattacacctcactacctctccatatgccgtggtgtgagggatactgccttgagtgatctaacccttgcccacctctcatatattccccctcccctcattcaatcttctgcagccacagtgatcttcctgtttctcaaataagtcaagcacattccagtttctatgcctgtgtgtttgctgttctttcttcctgcaatgtacttaaccctcctatttctcatccatcagatattatcttaaatatcaccccttctgggagcattatccaaccaccctatgtaaaataggccacatacctccatacgctgctattttttatgacaggtctattactttatttcatcagacttcttctaattcacgattaatgaatgtgtttgtttacttaatttctgtctcctccactagactataagttccagaagggcagacaacatttttcttatgcaacatatatttctagggcctagcacagtgtcttgtccataatttttgaatcagtgaatttattcctgctcaaactcccttctccaggctccccatcaaacttcatggtggcaccgccatgtccaatccactctcccagggaatgcaattccatcgtcttcaaattgttgtattctggcccagcacagtggctcacacctgtaatcccagcactttgggaggccaaggtgggtggatcaccagaggtcaggagcttgagaccagcctggcaaacatggcaaaatcccgcctctactaaaaatataaaaattagctggtgtgatggcttgtgcctgtagtttcagctacttgggaggctgaggcaggagaatcacttgaacctgagaggtgcaggttgcagtgagctgagattgtgccagtgcactccagcatgggctacggagtgagactccatcaaaataaaataaaataaaataaagttatgtttagccgctttctctccatcttttatgctaccaccttaattcagacactcgtcattccacacttacacaactaccacactctcctcatgggtctccctggttctcctttcttcctctctatcctctgtaccctgtcaaagtgacctttccaatatgcaaatcactcctagtcttaaaacctttcaatggctccctgttgcctacagaataaagttcaaacttcttagcatgacatgtgagatactctgagatcttaccttgtcttcccctctggcttgatttctccatcttctccagcggcccccactgcacaacctctgaacattttcccctgcctctaatcatcctgtccattctaccttctaaatacctcccttcaatttattcactgacctgcatctctacagctaccaatctcattcacccctggcctgagcaacccacacatccttctctctaactgcacactgctgtgtccagtccattttctaaacatcagcaagtgagcttttaatcatagaaatgcttgcctcctctcctcctggcctaaaatccctccatggaaacaagttgaggtttctgcaagatctggcctgtaggtatttctttaccctctcccagcaccactccctgcactcagacccactgtcaagcactttcttatcccagagtttgtgttcctacttacctggggacactttctccctatggcttactatccctttcatttcatagctcaatattctttcctaggcaaggccaagattccctgagtgacgtctcatagctcattggatttttcttcaaggcctttatccacccatataagtgtgggatatgggtgaaagaacaagtttgcagaaaagatacagtgaattatggaccatgagttcgggaaagaagggtaggactgcgtcgctggctgcagtattctggaggctggtctttgggctgtgatcactcttcattctaaaggaggtactgctgagatgttaaaaccattgttttactttttcataattttcagggctttggtgtatcagaaggaggctgtagcatatgatcaactcaaagtctggaaataatttcaatcatgggatttttgtttattattatgttttaatttttgatataagcttcatctttttttaatctgttaaacaaaggaatttctcatcaactcccctaaccttcctaaactacatatgcaattattcattcatccattcatttgctcagaaaacactcattagatgccacatcctttcctagttgttggaaaggagtcacaggcatgaagtagagtgaggtcttaagaccctttgactgtggagtgtggaagaaaaaactacaattgcatcctgggttttagaaagatcgtgaagcaaaagaaggtcagaattttccagtccagagtaacagataaccagtaagaatcacatctgaagtggaaggttgggcagggaccaaatatccaggtcccaggggtagaatcattcagctggagagagcctcttggagctatttcagccatgccaatgattttaaaaagtgtctcctttagggcttggcaggttcctataaagaaaagcatgagatcaaggtccactagatagtggcatttgcttccaggtgagtatcatattcccagcctgattaaagtcaatagccaagaatattgagactaggccactgctgaaggaaaatatgggaaaggattaggtaaggtgttaggacccctgcaaaggtctagctatgacaaaggactagcctactagacagcaacatggggcagattcccagacctgtggacttaaccagcaggacctttgtctaccagcaatgcctaagacttaccccaaactggactgattatcatccatcaattccaagttccaaatagcaaactgagactgtgaatgagacacttagctttgagccgaatgggctccagccgaggcaaactgaggctgcaatggaatggcagggaaaatggagttggcactgtctatgtcctactgtcccctggctttcttgtcttcctgcataacccctggggggaaccatcatccctgtgaatcacggggctgctgcctccatttgttaaggccttcgttctgtcctttttaaatatcactgttaataccccctcgtgacactgtcttggtcctttacccttttatccagatattattaaaaactattgtcaaaaatggaattctctaaagatctcataaaagtcagctgtgaggccctgttacagaggagcgcggccttgtgactaggagccacttcccgagtcgtgatttctgcatcccacagttttgctttttcaaccccatgatagaaaagcctagagcttactcccctcacaccctcacactgcatccttcctgggcttgaaaccattcttaaaagaactgcactatttttttttttaacattctatatgcttcacacttactcgtttcatatttttatacataaaatcctcccactctctctccatcacaacctcactacctccctccacaaaatactttttttttttttaacagacattttcagaacatcagggatatatcctgccctgggatgctgatgaatggccgctttaagactcactgagacactttggtgcacggctcagagtgctctgaaggagtagttttaattcagcagttttgatgtggaagcaaaaatatataaaatggcattatattgctgggtaatgtgttgtagcactatgaatttaatccacagcagccaggcacacaaaagcttacatttattattttttctttctttaatctttttttttaaaaaaagaaaacaacttttattttagatttaggggtacatgtgcagctttgttatacaagtaactcatgttacaggggtttgacgaacagattattttatcaccgaggtactaagcctagtacccaatagttctttttttctgctcctcttcctcctcccaccctacaaattaaatctgattctaacgtggttaagagaaacagtttctattatattcagtgatcctttcatctccccaaagtcacgaagtaagaataataataattattttagctatttcattatagtcagttaaacatggttaacacatagcacactgtggttcagacaccatctaagtgtttcatctttacaaactcacttttcacctcaaccaccctaggagttaccattatttttacccattttatagatgaagatgttgaggcacaaagatcttcagtccaagctcacagagtacacacagaagctgacatttgaacccagaaggcttgttctagaatatctgctcttaataactatggaaaataacaatcctagcacttagaggtcacctagcaaaatggagaaaggccttgtccttaatccaatgtgtctgccatagttaaccttagtctcctgatccatggggtggctgctgtgcttgaatgttcttatggcctctggcccctcatgggtcctccccctgatcaaaggctcaacacaggggtttggcccacttccctcaaggctgtgggtgtccaggtttccttgcatcccattgaaatcctccatccagggcaccatgtgcagttagggtatggatctcccactcacatgaaaacccctcattaccaatgttttcctaattcacataccagtcctttaaactgaagcttcagttcctcccatcctcacctctaagcaccagtctccagattccttccctttgagacaatccaaaacaatctcctcaagtaaacctgaagcacgaactctgcttatttcctttctgctagttgtgaatttgggactggagggtaatgagctctctgtttgctgcaatgggatggagaaaatacatgatttattcagcaatggtgaatgcacagtactttttcctcatctttaacactgatgtacatggaacagtcctcttcgagccatagcatacccctgaccccatcactgagctcttcctctacctctcacctccatcctatgcccatcccatcctcaccgagcctccaatcaccccccactgccccttttttcctcggttcttccccagccctcatatgcaccctgcacatttgggagaactgcaagcatagctcctgccttttgaaaactgaaataaaggaaaatgattaaataatatttattctacatttttgataaaaaaattttttcaggtaaccaaatagttggggataagaaatacccctttagagaagttttacagattataaatgaaggcaggatgagaaaatatcaccacttttgtgaaccctaatgaattaatccatctaaacaatgatcaggaatggctgccaaaaccaccaaaaagagaaaaggagatataagaaggcattccctgcttcctaaccaaaccaaaccattccctgcttcttgaccaaacgaaaccaaaacaaaaaagcacacaaaaaccctgaatcttacaagtctgtaaatctatgctgttctacaggagaccccagccacatgcagctattggtcacttgaaatgtggttaattctgagagatgctgtaagtgtaaaattcatactggatttctaagatttcatacaaaaaaccccaaacctcaatgattatcatgattgtatgttaaaatgctcacactttggatatattgagttaaatgaattgtgttatttgtaaaattgcatctctaaaccacatctcacacctcccttctgtctgatcctgaagcctaattctgcttcagaagcatgggtaagaatcaaagcaagaaacattattacttaggattggggtaaaacttggcagcaaggtgaagttcaacatcagggtcaggtttgattttttttttaagttaggaatgtatcaggttctttcaaaatatccatgcttcagagtggggatagacaaataccatgtgctcataggccttatgatgggtaggaagaagtggagacaaaaggagaaatcttgaggaaaggccccaggcaacatgaaaaagccgataggaatggtttggactagccaggcatggtggttcacacctgtaatcccagcactttggaaggccgaggcgggctgatcacttgaggtcaggagtttgagaacagcttggccaacatggtgaaaccccatctctactaaaaatacaaaaaaattagtctggcatagtggcgggcgcctgtaatcccagctacttgggagcctgaggcaatggttgaacctgggaggcagaggttgcagtgagccaagattgcgccactgtactccagcctgggtgacagaggaagactctgcctcaataaaaaaataaaataaaataaggaatggtttaagctgttcaggctgcactggcatctggtcttcctggtagccctaactagctttggccttgattttatcttcccacctcctcagctgtgttctgcatctctgtctcatcctcacccctgccatagggaatgttgcttggatatttgtttcaagacaattgtaaaattcagaagggaccacagagaattattgcttcatttgaacatcacagagctagctcagtagtggggtgcagctgtctaggatttgacttttagtagggatagtgtgatggatgtgctgcagcatcacccagcctggctctggattccttctccatcacttaccagagtttctaaataaagtcctgcatcagcttgcccagacttgtgcagaaggtaagtgacaatgacacctacatagtgcctcctatagtccctggctcagaggtggttttactgtgatgctcatgaaaattcaggttcagggaccctcatagtacagtgactccttcctagtgcccttgggaaggatttttagcaaattttattaatgatatagtatctttctcagagggcttttaaaatgtgcttaagctcaactcccccactcataaaaaatggatctgaaactactttggcccatttgagttcttaataaatatatctgtgtattctgtccttgctcgtacctgcctctttatctttctatattactctttagtgcacttctgcagggtccaaatgtacctacgattcccattttctatcttccctaggtcctgtttatgtaagtggtaggcagaataatggactctcaaagatgtctacaccctaatccccagaaactgaatatgtcaacttacgtgacaaaagagacactgcagatatgattaagttaagaatcttaagatggggtggattattttggcttattcaggtgggcccaacctaatcacaaaaccctaaagacagaattttcttggctgcctttaaagaaaaatgctctgttgttggcttgaaagagtgaggaagtggccacaagccaaggaatgtgggcagcctcaagtagctggaaaaggcaaggaaagagattctcctggacagcctggagaaggaatgtagccccaatgataactttatttcagcccattaggacccatgccagacttctgacctccagaactgtaagctaattcatttgtgttgttttgcgccactacattcccagtaatttattacagcagtggtaagagacaaatactgcatgaagatctgtttttctcttttcatcttactcttccagctgcttgtttattgatctgcctggtgatctttttattctttttacctcattttattcttttacctcctggtaattgtatcttttctctgtaagtcatgcataaaaaaacaaacagggctttctcgctggcactacccctttcatataatttattaagagtcctcctctgaaagggatttgcttaaagtccaatttaattagatttagcaccctgatatattaaaaatcccttagcatgaggcagctcttgcttatgggaatacaccctgaagtcaatgagaagctcaaggtgttagtttcaaattttctattttatactcttgtgacttttggcaacttaactaacctctctgagtacaacttaactaagctttcctagaacaaaaaactcacaatatattcatttccattccttttattgtgtttttgaaagatatttgtccacccaatgcaagtggacacttgacaagaccctgaattgaaagccctgtttgtgtttccctcccttgtttatagctggttttatgactccatcttaaatgtgcacgtaaggctcctgtagatgctgatggtgagtgatggggtctccgccttttaagtaaagcatgttttcctagaagctcagagtaagatctaattaaagtttgacacctcacatcgatggtgacctgagggttgcataacgatacctgtgtcaccaagtagttgcaaaaattaaatgagactcgtggaaattatagggcctgcacatagaaggctctcaatggtgaaatcacaagtcaaggagtaagcatgtcactcttttcttttcagaaacttgagtgtatttgaatatttacaaaatcatcccttcgcttttgcattgacaaaccgcattatctgaatccgcttagtggatactctaaatgagagtctgtatgcaaaagcactttgggaaggtaacaaatgctagatgtaactgtaaattcaaatttttaattatatattcatttttgtaaatctttcattcccagaatagaggcaccctattagtagagcgtgaaatgaaatggtatgacatgctgggaagataaatgtttatttgggttgatcagtttctccccccatgacatctgaagctcactcctgagatgacaggaaagctttaaagaaagattgaatcaaacttgcttcccttttttgtcttcctaaatgaaaaggagatgaacaacagtgaagtgttttattatttttttcattgatgtgtcagtgacttgaagagttagtggtgagcaattgtaaatattgacatccagcaggccaggaatcaaaccccagacctatctcttgaaagataatgggaacatggactaacaacgttagagctaaactttctttaacataaaatgagaataataaccatagattttcaaacgatgtcataagagtgaaatgaaataatttctttttaaaacggtagtgtggtcagactattccaaccaatacattatttgccaagcattatggagacagggatgaagacagcacacttcctccagccagtgacaatacaaactcaatgtctggtggaagaaaacaatgagtaagccaacaattatggtctagttatatgaatgtttgatttgaggtttcctttgttatatccactaggagatcgtttcctagggagagggcttggagagatcagcagatgagagaccagggaatctgatctgatccccctaaaacaaactgcagggccatcagagatacaatccctacagagtttcctctgattttagcatcatgatccttttagcaagttcagaatcacttggagaaaagagaagaaggtattgtcctcaaaactgacaccgttcccttaattaactcatcaaattttgtagtacatttgcttctctgaaggacttgtcttataaatgcacttctctgggccccaaagtgaaagatcagctttggtagttcatggtggtattctggtacctgtatgttaaacaccgttcccaggtgatagtaatgtgcaagaaagttcgagaggctctgtcttgaattctgcaatatagatgtgtcagattctttcataatccgcaaagacatgtgcctcctttcagtcatttgtgaaaaagcatctttgcctttgttgagcagcacttggtatatctttgctgagtagccctgtgtttctgcccttggctacagagattacccaactgcactcacagttctccaggtttacacagtttctccaactgtgttgaagtttctgcaagtacatgcgaagttacacagagatgtgtaaatttccctgattgtatgcaaaatcatacagatgtgtacagttttcaccacatgtgggtgaggttctccaccatttgaataggcccccaactggcctgtctcttcctcatcaggagcttctctcacttggattcaggaacccatgcaaagggttcccttttatccttgctttattgtctacacctgcattttcctgcctggtgcatgccctttgtgaaaatagctatagtactcactaatttcctccggaaaataaaagctaacccatcgccttgccctgcctcaactgtagatcaattcacctctgaatttccctgaggatgctcttttcagattggtgtgcttttcagattggtgtggacaaaagcagaaaggggagcgctgaaatggaggggaaccccctccacattgttctgtagctatttgggttggttgcaacccacaacaagaggaaaatgaaagtcctgtctgggtctgggatgcctctattcagtggtttgaggagaaagcagcgtttaccgaccctgccactgaactgggagggagagggggtagttaagccattggtctggaaaagctctctggaaaaggtgatcacagactattaacctggcagtagattggcagcacatgttccacccaccagctaaagtgccagagctacattaagacccacaatactttccactggctaaagtagatagtattccaactggaacaggggagaatctaagcttagaaacaataacagctaaaaacaataaattgaaaccagaataaataagacatcctcaacagattgagatctgatgttggagcctcaatgcccctgcctgccgaggactcctgcctcctcaatgaggcaggcagagctgagctttcccaggagtcttagagtttgcacagacataaggacagaaaaggaaaggaattaccacccttaggagtgatctacaaatagcatcccaggataaggacagggcaggctcttctctttagcatctagagtccataggaacagtaaaaagtttaaatcgtggatgccatttgtttttctagacaaagccttctgctttcatcccaggatttcaaagcccctcacagccattaattcgtcgtaagcaattcaggcctgtcaacgtttcacacctaatcaagagctgatatctgtcaccccaagggatctaaccaataattcctctgcacgctctcctttcctatacccttctcccaagtcagttatttttttattttatatatatgcatattttaaacttcaagatcccctcccccttctttttttgtgtgtatgtttttttttgtttttgctcttgcagtatctgactccctttcccttttcttacccttccttttctgcctcttctcccaaggtttctttgtttgccttcttattttccctggatggagttgggaggaatctgtaaaccaaggggcttgagaccgacatacggaagtccatgagtcccaggctttcacagagaaagccccaaatgaagatgggttcctggccatgaatttctatttctcatgggacatgattatccgtgactaatttgtctccctgggcagacaaaaccactgccaatgtaccagctttagtaaagctgttcagggctgtgatttccaaggaaagtaaaaaaatccagctctatgttttcaacaggctcaagacttcctcatgccctcagtaaagacaaaacctgattccattgcaataaatcacttagagcaggaatgataagcctgctgcacaggtctatcactctcatctccatgcccgtgcagacatcactaatcaagcatagcactttcccccacccccatcccatatccacctccctgccacagctatctcagaccctgaattcctctcaagaggaaatgtgaaaactccttgccatctctgatgcagggcctttcctaccttgctactcaccacatccacagtccatctttcttattttgtttgtaaattttaagcttaattattttggactttttactatatgtaatatatttaatataatgtttaatgtaaaatactaatatactaatattttatgttcttaagcgtaatcataaaactaatatctattaacttactaacctaaaataagaactagaatattactaataatctgcatttattgaaagatttgtctccacccacaccactgccttccatccatgaattaacacctatcctgaattttgtgtttaacatacccatgctggctggcatatgtgtgtgtgtgtgtgtgtgtgtgtgtgtgtgtgtgtatatatatatatatatatatatataaaataggtatacaccacaggcaggcacataggtataccagaggtatccataggtatacaagcatacaaatatacaattttagcacatatgtacacatgtacttgtgcatataattttaccacataagtatatatgtttgagactatatacttattctcaaacaatatatattttagttttgcttatttctgaactttcagaagtaatacatattatcttgcacatagcaatgctgtatatattttcactgatataaagtattacattacaaatatgcaacccaattttgttccaggtattattcatatgatcaggctttttccaatcagattaactgtgaaaattctcaaatattttcatggttcaactgtacaaggtgatttctaacatgcatacttcagagtagaattgttatatgctagaatttgtgaatgctcaaacttaccagataatgccaattcatttaccagaataattgtgtatatttacaccctcatcaacggttttagaggatttcctgtcagtgcctttctctcaaatacttttgatttttatacattttccaccccacctcaatctagaggatgtaaaattgtatctccttgtggtctttacttgcattccctagattaacaattagactggacacaattttattgatttatggatcatttgtgtttcttctgtcgagtgtctgttcaggagctttttcttccccccttctctttttgttattaatgtcatgagttgagatctgtttgtttatttaatatatcctggattttaactttttgttagatagcaaatcttaaagattgtgtcctgtattttcactttctttatggatcctgttaatgaaagttcctgatttcatcactttttttttttttttagacggagtctcgctctgtcacccaggctggagtgcagtggcgcgatctcagctcactgcaagctccgcctcccgggttcacgccattttcccgccgctgggactacaggcgcccgccaccacgcccggctaattttttgtatttttagtagagatggggtttcactgtgttagccaggatcgtctcgatctcctgacctcgtgatccgcccgcctcagcctcccaaagtgctgagattacaggcgtgagccaccgcgcccagccttcatcactattttactaatgtatatggtgcttttgaaatataagtattaatcttttgttaaagataaaatatcccaagtatgtgacatattttcatatgtctgttaataaacataatttttttcttactgttctatttttgtttaagaaattattttctacacaatggtaaactaaagcaaagtgatgttgtcacttctggaaggaagaacataataattgccagtgttgagctcttcagccttgtttttctgctgcatggagaaccctgaaggcttatgtcgagatgttagtgtcaaaaaaaagttaaatcttccgtcaacctgtgaccctgagtgacatctacaaagaatagaatccaatccacttcccaccaactcaggttggacatatagtctgagtaagactttgttattttatgccactaagatgtgagggttgtttcctaatcataacctatcctatcctgacaggtatagtaattgtctcagcacactgactgaattactcttctgtttctcaagggtacaggatacttcctttctcacaaatcaactttctatatgtgtgtgggtctgtttctggaatcttgttttgttcgaccagccaaattgtctgtccctgaacaaatattatactaccttaattactatggtttcatatttgtatttgaaaaagcaaaccttcctatcttattcttcttcaagaatttgccgtgctttgaccctttgctcttcaaaataaatcttgtagtttgccaaattacatgacaaaccccattagatttaatgagaatatttatagatttactttgagtaaaactgatatttctgacactggctcttccaatctagaaacatagcatgactctctatcttgtttatttttagttatttcaataaactcctatacttttccagacatagtatacacatttgttttatttatttctatgtgacatattttgagttgacttctaattttaattgtgaatgacagttttaaaacttacatattccaatggtttcttgttgatgtatagagaagcaaacaatttttattttttattttaaagccaactaactttttatcgactctcgtattaattctaacaatttgtggattcttttgattttctaagtaaacaatgatatcatctgcaggtgatgctagcttggtaccttccttttgagtttttttgtcttaatttctcttccttgtcttactgccctggctaggaccctggagccatgttgaatataaacttcatgtttatattccttgtcttactgccctggcttggaccctggagccatgctgaatataaacattgaacttctcatctttttctagtccaaaggaaatgattgtcacacttgaccattaagaaagttacttcaactaacaaaagaaaacccaaggatggaagtagaacagttctattgttcaatctggaataaagtaatgaataaaggcattggacatctgtgacctttaacatcacaataaagagagaacagacattatgtgactcccggtaaaaaaaatataaccccctagaatctgtcctgccaaagagattggacttaaatctctgtatccagctgccaatatacaggaaatgcaaaagataaggaaaatgttgagctacaccatgaggatgcactcagcaaaatccaggctatgaaggagtctataggttaaatgccctgggttcttccacaaataagttataaagaaaggaaaagatgcaggaggacctagagattttaaaaagttaaatgatatatgttttctttaaaccaaagtgtccaggatgagataactgtaacaagaagtaaagatgtaaatagtgataaaaattacgatgaggtttatcattgagaggagagcaagggttgttatagaaacagggcacatggtgggtcttccatgatggctagcaaagttctctttcttgaactaggggtggcgattgattacaaggaagtttgcctcattaaaaaagatcattaagctatacatcttgggtggttttcagtatttttattttattctaaaataaaggtgaggaagttctatccctatttataaagattttttttaaatgaaggatccacatttaattttttcatatgttctttgtgtatcttttgaaatggccatatgacatgttatttcttcttacatgtactgatggtacatgtaagtacagggtactgatggtacatgtaagtacatggtactgatccatgtacttacatggattacatgtactgatatgctaacatgttaaaccattttacattcctagaataagaaaacagccatttttttctatgaactacaatatttaaccactgctagattctgtttgctaaaatctgcattcttgtgcatgaatgaggttatcatctactggctttagtataaaggtaatatcagctttaaaaaatgaactaagaaatcctcctctgtttctctctaagactttgcataagattggaattatctgttccttgaaagatcggtgaatatcacctctaaaatcatcagagtcaggtattttcatcatgaaaagatttttaacttctcttcaattactttaatagtcttatgttaatagttatggtctaattaaagatttcttatgtcttcttaagtcaattttgttgttatattttcctaggaatttgtcttttttatgttttttggtgtattggcatgaagctacttacagtattttattacatctctttaatctcttctgcatctatagcgttctcccctctactatttaataatagtgtcaatttgtgttttatctctctttttctttttctttaccagaaatttgaattcttattagctttgtcatatagcaaacctttggtttttttatattctcagttctgtatttgttttcagtttcatttatttcttctgtatgttcatcttccttctgcttcatttaatttgactctattgtttcttttctaacttcttgagctaaatatttaggttatttatgttaaatttttctcataaaaaatgtaatcctagcaaatgttgctacatctcacaattttgatatttagtattctaagtagttttatatatttaaaataattttcttactgatacatacattaataagtgtgtgttttattatatcttattatcaccttttaatgtgattctgttttgtctagaaaagttatgtttgatatcaattttttgaaatgttttagaattgtcgtatggtataataccttttaataaatatttcctgggggcttgagaaaaattcttattccctagttagctgtgaacattaacagaagtttattgtcctaattgttttaattctatatttttattaagacttttgttcattttacctatcaaaaattgaattgaaatcttccactacagtgattgatttgaccatttctttatcaaatctcatcaattttgttgcatatatttggggatcttttattatgtgtgcactagtttagaattattatacttactagtgatttgaatcatttctaattatagtataaacttctctatttttcataatatgttttgtcttaaactctattttatcttatattaatataagtactctagggttttttttagtgggggtcagtctactttacgtgaaacaattatgtgtcctccagtttcagttgtgtctcttggaagtagtacataattggagtttttcttaaaaatccaatcttaaaatgtcaattttaacagaaatgcttatatatttagtttattgaaattcttgtcatatttgaactttttctgccagtttgattcttcctgattcactttttctatttttctattttcctttgatgtttcatctttttcattgtattggcttttatgtcttttgcattttactgtattttttttcttccttctatgttttagctactggtttagaatttatgaacattatctctagggcttcaatggttacccttgaggttttacatttcaaatatatataaattatatttagttagatatatttaactatataaatattaaagataatcaatacgttaaatcctgtaactaataaaagaatattaaaactcttacagttcagctgtagttctttcagattaaatgctcttcttacccactgtttaaaccttgtctttttaaacctccaaattgaacattattttataattattgtatgggaataatcatatttgcatgcatatattttattggtttatactgacatgcatatttacaattttatttgttcagtattgcttcttacttcacagactatcttctggaatatatttttttctaaagtacattctttatcagtctccttattgatagcctatcagcactaaccttcctctgcagtgtttaatgtgtgtgcttgttcttaaaagtgcctttatttcatattcattagtggctggtgaaaatgctcacacatgatcaaattctaaaggcaaaaatcaaggcagagcttgatatttaaacaagataataggtacaataaaaataatgcaattttaaatatgaaggcagaggtatggtttaagttcttcttttggccttggataaattattcagtaatattcattaatttatgtgtgaaataaacatatggtgtgtatctgctaattgcttggctctgtcctaggtgttcacaattaaaaacataaggcatggtttctggctacaatgagctcagtctataaggagattcagacacattaatcagaaagttaaaagatgattttgtaacggggatatctatttatagtatcttaagaaaacgtccatgggaacatctacctgggtttgggatggggaaggttggtgagggttggcttcctggaggtcatgtgagtagaagaggaaaacgtatgcctaaagaggaagaacagagagaagaaaaagaaaaaaggaagaaaagagaaaggcccagtaacaaaaatctgaatgccatgtatagttaattaataacatgaaggtggggcatacatttgaggtcataagatgttagaggtttaagcacgggccaggtcatgaagggtcataaatgctttgccaaatgttttggactttatctcataggtcatgaaaactcagtaaggagatgaaatgataatgacaaggtcatatttatgtttcagattgttgactccagtgagagtgaagaggccggatgggggttggagaggcagagctggtgtcccatctggctctgaaccattttatagtccaggcaagagctgatgaagactaaatgaatcagtgatgttattgatggacaggaagagtataagaaacaaactctgcagatgttttttttttcagccatactcatcacataagtggtgagtaaaggagagaagaagcaaaaaataattcattgatttctagctctggtattggatagatggtatggccactaccccatcaacaaaaagaatttaagaggaaatgcagttttaaagaaaaaaaaagttgaatttattttagaatattttggattttagatgccaatggtcattaaagttgaagtcattgaatctgaaatgcctatcttcaagctttagctttctaacacaggaaggcatttatataagccaaccctagggcacagctatagcatataattccaatagaatattggggttctaaatttttggtataatatacctcataacaggctctagagtatccaaagccaagcctctctgaactctgaatccacagggtaaggagggaagcatcatgctggccaacacacatgcagtattttctttctctcatagtctctggtctctaaaaattgaagctcatttggcttagatggcctagtttaaggtcatttcctttacctacaccagagtctaaggtggcacatgctttatcaggtgtttgtgtaggcagggactttacctgtgaccagtataatcaggcttcataatgtgtctttacctatttgcttaggaattatgtgtggcccacaaaacatggcccaggaattattttatattcctactttgacattctctgcaacgactatcaacccttgtcaccagaacaactcaagccgttctctctaagacctgaaacatactctgtaaatcaatcctactcattcatacactgggagctacccagacccctcttagttatattggctgtatgcttatcagaatttacctgaaagtttctccatgcaaaatttctccccatagagttatccaagaccaaatgatatgggttctatatttcctctggagctggaatctgagtgaattatccttagatcttcactgtcattcgagcatcacctctgaaaaaaatctctacgtttccaaggtcgcccctggaaatgtttttctagaagaaccagatatatgactcttccaccttttatcttttagaaaccagagcaatgcaataggaatggtaattttgatgccctaaccaaagttttatcagactggcatccaatcaaggatttaaccacttaaatattgtgctttgataaaagttctactgagaatttgtgattattggagttcttttacagggtacttcataagccattacataagacactaattatccaatatttctaccagcaggtgatcttgtactaattaaattaacattgaaaactgctaacatcattgattaagggtccaaattgttactgtatatcagtaacaattaggacaacttcattttgggcaaaaatcaaatctgcctttccctttatcacaggagattaattatcatcttttcctaagaaaccaggctctcacctaacaataaaggctcttgtgatttgtctacattttggcctctaattatgaagtttgaggatggcagtcatcaggttcatggagtggttaatatcaagaaatctgacttcagatttggttgaacatattcaaatctcagccctgccacatagcagatatatactcctaagccaagcatgatcttccattgggctcagtttctttttccattgtacagtaataaaaatagtccctaccttaaagggctgtgatgatccctaactgaggacagccttgtaaaagagttaattatcagcctgacacatgaaaagggctaagtaaatggtggttattgccattatcagttgtgtttctcattctcttgtgctaatgatttaatacacttccaatatctcttccaaaaaccttaaagttggaaggggatgttgagaagatcaccttaacgaatctttaactttactgagaagcaaaagtgctgacttaataggatccaagggagactccagtggctggtcattatacctggctatttccctttttgtaaaagtcatttgaaaaacattgaataacaaataaccatgaagactttatgatcaaagattcccagaactactgtgaaaaggggaaaaaccatggaagtccatatttccagcccagccacactgtggacagtcctcaccttcctttagaacttttgctcccaaatacagagaacacctgtgggtgatttggagccattgtttttgagaattattctcataacatcaattttaaaatatatatgtttaatctatcactctctttgtgccagccatcatgctaaacttatctgcattatcacattctgtcttcatttgaaggaggtattaccattacctccaaggaagtataattattcccattctataggttaataaactggactcaaagagggtaattgacttttccaaggtcacccagctagtacatgatcaaggtggaacttgaatccacattgttcgcattccagaacccacagccttaactaccatgcacaccacctccatgggtgaagaccctcttctttcctgtgggcatccttgggagacagaacacccaggagctcctgagtaccatttttattttggactctctgatgcccaggatttttggtggcaattcggccacctttggataagtttgacatcttcataaaattcccattagccctactgcaaaacagtgtaaatgagccatcatccaaattcccaaatctatccctggccttcactccttacaatttgactgacaaggtagccagtaatactatgtacccagaagtttgcaaattaatgtcttcttctggccctccctcattctgtcagagaccctctctcccaagccccaattaccaaacttcatctgaagcctcattttcaattctcttttcactagaagttccaagtgtctcctaacccagccttttcaaaactgacctaccctctgtaatccccaaatctcccttttctctccactctgcctcaaacccttcgcagggcccaccttcctcagatcctctttttcagtacccacattctacacttgcattgcagctcagcctctccttctgtgcctccccgtccacccccttacacgctcaggccctataactaagcactccatctaatggaccttcttacttagcctcaatgtttgctttccgatacattggatttatagagtgtttgcctgaattaaaatgcgaaattttagagcaaaccaggcttctcagctgctaagctccatcatgtactttaaataaggaggagggggagtgtgtgtggaggggtgcctgatgcattgacctacccctgaattaccatctcgacccaggctgctcaccttccaacccagctggtgcctacctggccctactcacctcccccagctaaattaacaaagcagttactgctcatccgcagagctccctctaatcaactcccagtgaaataatatttgctttccatgcctactttgaatcccactcactttgttaaaagattgcctctggctgtctctgctggcctaatctaatagtttctagtttgtacaagcaaagcgttttcagccacctatataaataacttaagcaggagaggacacttgtacagccccagtgcagggctataggacatgacagatcccacaatgactccttggccaatctcctgggggagcaccacccgctgagtgggagcaattactgtactccatgaggctgacaggacagtctgtctgtctatagaaagtctgatgggggaaaactattcccgtctgttttctccagtgcaggtgaccatcctaagtgcctcggccccctctatacccctccatactgcctgatccatggtctcagagggagcctgttcaaagtagaaaaagcggagaggaactaaatcaatctattagttttcctctaaaaattgtaatgcaatcaactttgcttttaaaaaattgtggtaaaatatacataaaagattaccataaaagcttaccatcttagccctttttaagtgcacaattcagtaatgttaagtatattcataatgttgttcagtctcgctccagaacatttttcctcttgcaaaactgaaactttgtacctgttaaaatgacagtttcccattttcctctccccccagcccctgagaacccccatttcactttctgtctctataaatttaactattctatgactgcatagaataagtcacacagtctttgtcattctgtgactggctaatttcacttagcataatgtcctccagggtcatccattttgtcacaaatgggggatttcctttcatttttcagttgaataatatgccactgcatgtgtagaccaatttgagcttctcattcatctgttgatggacacatgagttgcttctaccttttagctattgtgagtaatgctgctatgaacatgtgaacatggctgaacacatacatctttgagactctgttttcaaatcttttggatatatacccagaattgaaatttctgaatcatatggtaattctatttttaattgtttgaggaaccactgtatggtttttccatagcagctgcacaattttacattcctaccaacagtgcaaatgggttccagtttctccacattttctccaacatttgttattctcctcctcctcctccctcctcctcctcctcctgctcctcctcctcctcctcctcctcctctgctgactgatcagggtgatggttgctgaaggttggagtgagtgtggcaattcctgaaaacaatgaaatttgctacatgaattgactcttcctttcatggaagatttcttggtaacatgtgacactgtttggtaacattttactcacagtacaacttcttttaaaagtgaagtcatttctctcaaaccctgctgctgctttatcaactaagtttatgtaatattctaaatctttttttgtcatttcagcaatgttcacagcatctatgccagaagtagtttccatctcaagaaatcactttatttgttcatccataagaagcaacttacacattcaagttttatcgtgctattacagcaattcaagtcacatcagcatgcttatattctagttatcttgctctttctactacatctgcagttactttcccctattgaagccttgaacctctcaaagtcatttatgaaagttaggatgaacttcttccaaacttccattaatgttgatgttttgacctccaccatgaatcaggaatggagatctagcatagtgaatcctctccagaagattttcaaattactttgcccagatctatcagagaaatcactatctgtgtcaactacagctttgcaaaatgtatttcttaaacaataagacttcaaagtcaaaattactccttggtctgtgtgctgaagaatgaaggcatgaaaacaacattagccttgtgcatctccatcaaagctcttgggtgactaagtacattgtcaatgagcagtgagattttaaaaggcatctttcttttttctgaacagtaggtctcaagagtgggcttaaaatattcagtaaatcatgctgtaaatagctgtgctgtcatccaggctttgtttttccattatagaacacaagcagaatagatttaacataattctgaagtcctctagcattttcagaatggtaatgggcatgtggcttcaacttaaagtcaccagctccattagcctcttataggaaagtcagccgtcctctgaagcattgaagccaggcattgacttctcctctctgctaatgaaagtcctagatggcactttgttctgatgtattttatctacatgaaaaatctgttttttaatgcagccaccttcatcaattatatttcctagattttctgaatcacttgatgtagcttctacatcagctcttgctgctttgccttgcactttcatgttgtgaagacagtttctttccttaaacatcatgaaccacctctgctagcttcagtcttttcttctgaagcttcctcctctctcttagtcttcctagaattgaagagagttagagccttgctctggattaggctttggcttaaggaaaggttgtagctggtttgatcttctatccagcccaccacaactttcttcatttcagcaataagcctgttttgctttcttatcatttctgtgttcatcggagtaggacttctaatttccttcaggaatttttcctttgcattcacaacttggctaaccatttggcgaagaggcctagcatttagcctaattcagctttggacaggacttctgcacttaacagttaaatcatttctagcttttgatttaaaatgagagatccttcctttcacttgaacacttagaggccatttagggctatcaattgacctaatttcaatattattatgcctcaaggaataggaaggcctaaagaaaggagagagagagagagagagagagagagagagatggggcaatggtcagttagtggagcagtcagaatacacacaacattggtcattaagttcatatgggtgtagttttgtgcccccaaacagttacaatagtaacatcaaagatgtctgatcacggatcaccataacagatataataataatgaaaaagtttgaaatattggaagaattaccaaaatgtgacacagagacacaaaatgagtatatgctgtgtaaaaatggctctggtatgtttgctcaatgtagggttgctacaaaacttcaatttgtaatgtaataacatgaagcacaataaaatgaggtatgcctgtaataataattgtaataatatattccaggaactgttccaaggattttgcataccaacttactttcaacaaagtggtgttggttgcgtttatttaaacagcactgaaaaccacttaaaattggatattagatagttgggtcacattttcaagaactttgcttcatgcctggcaatttttcctaggtctcttcttttctcttatattttcccctctccattcacctgtctcagagattcccaaagtgctgttcacttttcattgagggactcttaaccctttttcatatatcacagtcttttttcagcatcttgcctgaggtcttaccttccacatctaaaccaagatatcaaataatctgtcctggatctcccaatgtccccctccatagggaaactcagagccagtgggatgatgacaaatatttcactctcctttttatatataaaagcaaggcattaggaggcacattttccagggtatacaacatggagtacagggtaaaagtagggccacaggattcctgtgctaaaaatgagaaagaaaacactcagcttctgagaaatggagaggggttagggagaaggagaagaatgcagcaggtattgactgctcacagtgtgctccgggctgtgctgtactttatatgataattttgccttcacaaaaactcaacaaagttggtactattatccaaatagcagagctgagtaaaatgaaggttacaggaattaagcaacttccccaaagtcacacattttgctaacaacagacaacagattttaaacgtctgctctttccactacatcacgctattatactttgtctagatacatatgaaagaaaagattgtttaaacgctcaatgagttgaccttaatttgctgtggctatcattgtgacctttcagtggcaaacgccaagatctcttattctctgtgtctgactcatatttccacgcaccctcatcctcataggagcacgtgcaacaactctccaataggacttaatagaaacaattttcaacaacgtttttactaatttcccttttaaaaatcaataaatggttagtgatgccattaatagagtgaaagcagatttctctctattatgagagttcatatttgtagcatttatcacacacacacacacacacacacacacacacacacacaccagaaacaataaaaataaagacaaagaaaccactgagtttatgagaccctaaatacttggattgaaatttttgcagcccaaagagagggtaatgcaataaagagttctgtctcaggggtcagaaagtcatgagttcaaattccagtggcaagtcttcccaccttaaaggattgtattgaagattaatgtgccagggcattaacagcacttagcccacggtagacaggagatgctgtatcggggctagtcacagatgcagttgaactggtctccttctgtgacacttcctttttggaggcccaggatgtctctccccttctatgcacttcaattccattcctgacctaagttatcccactgctaccctctgcctggtcagcagccagcctctggccctcatccttcctcctccggtttgtgactcactaggtgacttccggaaaatcagttccattctctcaagtttaatattcctctcctttcatatttattataccattgtcagatgcggcccagaagtgatttttaaatgcctaaaactagcttctgatctttctgaaacaacccctgattgaatatgagcgacgttttttctttctttctttctttcttttgagatgaaatctcactctgtcacccaggctggagtgcagtgatggaatcttggctcactgtaaactctgcatcctgggttcaagcgattctcctgcctcagcctcccaagtagctgggattaaaggtgtgcaccaccacactcagctaatttttgtatttttagtagagacagggttttaccatgttggccaggctggtctcaaactcctgacctcaaataatccgcccactttggcctcccaaagagctgggattacaaacatgagccaccacacttcgcctaaatatgagaggctttaattttaatgatgagcaaagaaacacttttggggagattatttttgcagcctggttctggagaaatgcatggcttccaatgagatttcagaaatactgagtatacaacaaatgtcagaggaatttgaagggccaagttatccctagtaataaagagcttactcagccacacctggagaaggctgtgcagatgtcagaattcgatcaaataatattattactgaatgatcagagacagagagttactaggcaagaagatccaggtgagaccagaggccacaaactttgagggacatgcaccaccctggagcagagaaataaataagagacaaagtcagccccagagtagaagggaggaatgcaacagtatttacattttcttgcttgctttgattagagtgaggtctgagactatccctcagcagtttcccttctgctaccctaaaatcaggacagagtactccaggaaacctggatctaggaaaggatctagtaacctccagacacatgctgaatgaacctccttccctggctcattccccagcagtgaagacacttctaagttaaagtctacattcccagctggaaaaagtcatgaggtacctgccttcttcccactcagaatctactattttatatgtgtgggggaaggaaatgggaaaatatcaccccagccctgctgggagggatgctgaatcactgagctcatgggatgtacccatattaaagaaagtcaactccagaaaaccaccaccaagtgttagcaagcccctgttccccagcagtgccaccccaaatttctggcatttaagagcgcctccttctcctatatcttggtttctatggaaaagagtaccaacctgccagatgcctttggcaagggaaaaggaagaaagaggtggactcctggggggacaaacatggggaggctggaccttgggtatttgaagggccacatgcaaatgtaatgcaaatgaagtggacccataagagagagggtgctgttgaagacttgctgtgcatgtgttggagtggcacccaaacatttcagcctccccttctttctatacctgaacaagtagttggagacaagtaattccagcaagactgtgccatagttctactacatgtggactagagaaaggagaggtttctcttttctcagaaaactcaggtcagtgatttactcaaagaattattaaggaaacttcttgacctgtcagctgatagggtacactgaaaagagaaatctttccattctatgcctgagcccctacctgaatcctttcccccaagaatttgggttttattaaaatgatttagtctatttatttatttatttatttatttatttatttatttatttttgagacggagtcttgctctgtcaccaggctggagtacagcggcgtgatctcagctcactgcaacctccgcctcccaggttcaagcaattctcctgcctcagcctcctgagtagctgggactacaggtgcgtgccaccatgcccagctaatttttgtatttttagtagagacgaggtttcaccgttggccaggatgatctcaatcacttgacctcatgatctgcctgcctcggcctcccaaagtgctggaattacaggcatgagccaccacacctggcctagcctgctattttatgagcccctcttatcactctcactaccctctagaacagcaagcactgcgagaaagaacccagcccctgctccatgtcctgagtcaagaactggccgagctaagacaagaccaacacagctcttgccctagagctcacagcataaatggaggtgctgactcaatggtcacatggtccagtgagggtgacactggagctatgtataaggtataagggaggatatttgaatgaggccataaaggagtaaccatttaggtaccagcagaggggacagtggcagcagatgtctggatgtttcaatagaagagttgacccctgacttgagtattcaatgatgagtgtcagccaagcagaaacagaggattagtatttcagatgaagcagaaatatgagggaatgacagaacaggctgggcacatgatgggaatccccagaaaccagtctgcctaaggcatgagagagatgaaattagaaatgtcgctgcaagcttgctcacacagggccttttaacccaaggaaaatgatgtgattcttgggacagtaaagagccactgacagttttagtagcagaagaacctggtcagaatacttcatttgtggttggatagggacacatctggaggccaggagaacaattaggaaggaactgttgggttccaggataaagatgttttgggtcaggagcaagagggtagctgttatgttgcagatgaggagatgggtgaagaaatgtgagaaagaaaagagggggatcagtgattgctttggtatggagctgaagatgagaggaagttgatggtgacttccagatttctaacttgggagaaaggaagggacatgggttcaggcaaagaaggaaaaaatcaagaaatcatcattatagtgtcaagtattccttctgccactccttctcttcctcaatctctgtctccctccacaccagtctcttcgcagggctccagcctgtgtgaggggctctgaatgctggtgcttgcataactgatgaggatgagttaaaggcagcttctagctgagatagctccagctgtggccacagagactaataggattgcccagaagggagaagctccagtgaatggaggaaattctgcatgcagtctctctgactttcagaatcttctggtccagaagtccttctgtcaggtggccttggcatgtgaccagccaaccaagagcacagagatcccaaggtttccagaaatcacaagaaacatccaagaaacaattctagagaagtctgtggattactgttctagcagtcaggtccagaagttggctacaagagacgagaattggaagagggaaaattcctcaccatcaagccaacgtcataatcctgaggacatgagcacagcaaggaatgacaccttcctctaggatcacttaaaggatctcagtgtcactgagctgaccacagtgtccttgggtggaaagaatggatgttgtgtagcactttggagtcagcagtttttatacatatgtgtatatatatatatatatatatatatatatatattttttttttttttttgagatggagttacctaggctggaggtgcaatggtgtgatctcagctcactgcaacctccactcccaggttcaagtgattctcctgcctcagcctcctgagtagctgggattacaggtgcctgcccctacacccagctaattttttgtatttttagtacagacggggtttcactatattggccaggatggtcttgaactcctgacctcaggtgatccgcctgctttggcctcccatagtgctgggattacaggtgtgagccactgtgccccctcagcagtatatattttttaaatctcatttcagactagctctgtgactttaagcaagttgcttttcctttctaggactaattgtttttacatctgcaaactggtgatgatgatctctatttcacagagcaaagggtaggtgaaatgacaatacaaggtctggtcaatattagatgcttagtaattattcattcaatcattcatgcataacatacttattgatttcttctacatgccagacactgtgcttggtgcttgggaacaaaacagagaaatattttcacctaagtagagctttattctaacatctatatgtaggggaggacggaagaaagacaacattcaataaggcatagtatgtaaattatttagtttgttagaaaatagtaactgctataaagtaaaggaaaagtcaagcaaggtaggggaaagggcagcaggagtgaccttgaacaagtcactttatttgcctgaaggttttacttcacgtgtaagtcaaacacaacaatacctacctcacaaggctattgtgcagaataagtgagtgcaagtcacctaaaattgtacctaggcctttatagatgctcaatagtaatagttatatcatcgtcaccattatcatcatgaggttgcaataataattgggcaaatcagaactcatttagaaggggccatttgagcaaaactggaaaatgatgagggagccatggggtgtacggtgtgcatcccaggcatgggaccactcaatgtcaaggccctaagacaggagcagggatttcaggaaagctgtgccacctgactccaccggggagatcagaaggggctcagaaaagcatcccctctgaaagaagctgagaaaggggaagaagcagttggaggttgggtggccccaagagaaaaagaactttggagaactaggctgttgctgaagcaacaaaaatagaaacatggaaatttctcccagctgctgtgaactgaccctggaacttagagccaaactggtggtcataaagtcagcttcaagtttgtgtgcctgggtttctgcatccttcgtgaccatgtgcatctttgtgtacaactgcatctatttgttatattttgtgtttgtgggaataggactgtgtctctgacacatgcgtgtgtgtgtgtatggtaatttggaacgagaaaattctcctctttctaaagcgatgtacatacaatagaggaagtagagacagagtcatcatgcttcatttcatatccatacttgactttcaacattgaagttacttacctttgagggccttaagctttatcccaccatcctctcacaggtgcaatacttgtcaaatgtctaaatgcaccacagcctcaggcctgcccgaaatttagtcatatgagatgacatttatggggcattgaggataacgatatcacccattctctcaaacattgtattgttgtgtatctacagtgccagaccccagggttagattctgggaatataaaaacaaggggccattgaaggttataggctttggaaacacgttggagtttgagtttcagctaattcccgttactgcttgtgtgaccgtgagcaagtcaccttatttttttaagggttttgcttcatctgcaaatcatatacagcaatacccacctcccatgggctattgtggagaataaacgagtacaaatcacctgcaaggtaactaaaccctgatagatgctcaagagtaatactgaagatcatcatggtcatcaccatttccatcactactgaccaaagtttctgccctcacatggcatgcatattggccgaaattacaattccactgccttggtctctgatcctagatctttccatggcttgttatctagcttcgtttaggctattattcataaaaccttcttcagaaaagtttccctgaccatccacccgcttttatttcttcactgcacaaatcgtttcctgtaattctgttatatgtattgtttttgcttacctgtttatttgtctccttcagtcaagtatgcttcatggaagaacagtgaccttatctctctagtttgctctagaatcagatgtgaactttatcttcagtatctaggacagtatctggtacaagaaggtgttcaatcggcatgtgttgaatgaatgagtctatgaatgaattagttaacctgatttgtgccattacagagccccagaaaaaaatgcaactaactctgctgaaaccaaagtattcctgtagaaagctttacagagcagagagcatttgatcagggagactggcaagggttctccggcaaatgcatgaaggggcatgatcatagctactaattgtgactgtatcttgtgaaacaaaccaagatcatcaatcgtgttccccgtctccctggagaacactgctgaaccttaacacatgccctgggagtgtgtggaaaagaagaaaaaccccaaatttctgactatgcataatccccttcagtcttccagaagcataggtccaaacttcatttgcatataaatggtcataattttttaatcatagataaattccattctgtttgcttgtccttttgccttccttgatagagaaacaagagtgacttatgattcatgaggaacagcaattaaaacacatatacatacaacacttccttacttcttgcatctcttttcactccttctccctccctgagtgtcagaaaatgccatcttgattgagaggtagtggttacacagtggattcccatggtttctttccaaatcctaggttcttcactcactttctatgcaattgcggacaagtcacttcacctttctaaaccccagcctcatcattcataatgagtaaaacataaaatcatgaaggttttttgcataggctaaaagaactggtgcacctaaaatactaacataaagcaagttctcaaaatgaaagttattatcattttattagtatcatcatattgtatgaaaatacatagagatgactcatttcaaatcagcaagagaaacccaaggtcttactctcagcagagaagagagagaaataaagctactatataggaatgttgatacagattatacctagatggtgatcatattgagaaactctgtatttcatctcagagagatcttaaattggaaaatagtataggtaccactcaagagaagatctggtccctgaaccttactaatatctgacattaggaagtagaccagcacgacaaaaatcagtcatcatcggacagagatctatttgatacttattttaaagacaactgtgttggtttctgtttcaagccctttactcttgttctgagatcatctgtgggagagaaagggcaaagtgcaagtgggggtggaagtgacacgtatcaggtcctcctgcaggtgttttcttgctttatctcatccgattttcacactgccctctgagacaagatttattatcccaatttgcagatgaggaatttgaggcttaacagggttaagtaatttgctcacatctgctgaaggaaagcctagacttgcagtcaggcatccagaatactttcatttataacacacatcctgttttacatggatattgaagatgtgggattattttttagccccagtttgtggacatctcttgccagagttattttcctaagaacctagaatcatttgtttgactgtatatcaggcttctgtggatgcaaagcccactagcaccatgcactcaacatttccaaaactaaacccaacatctgcccactccctcatttccacgatctctcttcccagagatctactccttttacacttttttccaaataattgtctttccccatgcatcactctagactgcttcttcaactcacctcccatcatcacataagtcagtaagtcttatctaatattcctttgaagatatgtcaagtccaccccaccagctccagctccagcttcactattaagtcaatttatatctcacttgaagcaggtagctgtagcctcctctctggtgtccttgtcctggtatttatcactctagcccatccttttggttcggccaagtttattgtcttaaaaacaaatgtaatcattgtgccactcctctgctgcttcaaaacctttgaggactcccttctgtctacatgttgaagatcaaacaccttagcaagtcacctgcaatataactcaacattatgcttttgtctcatctcttaccagcccccatggaaatgcctaattattcctctgaaatgcattgcatgtttattctcttgtatttttcccattttaaggaaaatcctactctgatttcttgtctgttaacaactacttaatctccaaagcctacagtgaatgtcctgtcaatctcaccaaacttccccagacaaactcagctccctcccttgtcagtacttcatgcacactgctatcattggccctaccctgtgatcatttttacacacacctgcctccctcagtatagcaggagcttctcagagataaatatttttttttcacatttttcttcgtctccttagtatctagcctgagaagtttccgacagtgagaattataatgcaggtatcattttgcatgttaacactaacatatcataaacatgttcccaccgagctactcagtcttcctaattatccttttaattgctacataatatttcttcctgtttatgttctataattacctaaacattcaattcaagtcattaaattcaacaaaaatttctaagtacttaatatgcggcaggtaccatgctagatgctggagacaccaagaggaggaagacatgacctcttccctgcaaagactgtgcattccagtgatcatgtgataagggctatgatagagatatatcaatgaatggattgggaacactgggtagggggagttttatttttcctgaagaagttgaagaacataaatttataggtgatattttctttgagttttaaaagttgaatacaaacctaagagaactggtaagaaagcaaagagggagggtgagagaaaagataaattactaagacctcacagtttttaaggggtcagagctaggatttcaatacaaacggtttgattctaggaccccactgttatcccttatctgctggtaaattcctacccacccaacaatgctttgcttcaaccagctccacactctttctcagttgttatttatttatttatttatttattttgctacagagtctcactctgttgcccaggctggagtgcagtggcgtgatctcagctcactccatctcccaggttccagcgattctcctgcttcagtctctcgagtagctggactacaggtgcacgctaccatgccaaactaatttttttgtgccaccacgccaaactaaatttttgcatttttagtagagacggggtttcaccatgttggccaggctgatctcgaactcctttcctcaggtgatccacccacctcggtctcccaaagtgttgggattacaggcgtgagccaccgtgcccagcctcagttctctttttattcagcccttatgtgttgcacagagctggggcgtgctagcaaattttctccaacccacattttcgttaagtttgataactagaattttgcaaagtattttttttgagttttacaaaatgagctcactaatatgatgcattctcatcctttgttcctgttttctataagaattgcaatgttaccaaggaaacaagattctagagcaaattcctgataaatgttaggttctcaaaagataaatgaaaaaatgatcaaccaatggctaaatgtatgagtttggctgtgtggaaagtagagaagaattagtagaatgtgaaaggctcatgtataatgtacttaaggcgtaatgtaggttacattatgacacttgcagaagtaaaacaataacaagaataacaaaaacaataataacaataaacagatacccaaattagtatcttggtaccttatcagaagcattcctgcttgtggaatcagaagatcaaagagtattaagagctatgatatcatccctaccctgtgacacactatttaatctaagaaaccatttaaaaaggggaaaacagcagatattatatggaccaccttctatattattaaaagtctggaaacaatctaaaatgtccaccaatagggagtggttaaataaattacaatatgtgaactggaaggagtattataaagtcattaaaatggtaattagaaagattatgtagccacatggaaaaacatttgctgtgtagtattaagggggtgggggaagctgaatacaaaattgaagctaggccatcaatgcagttatggaaaatgtatgcacatgaattaagacaccaggggaagaggcatgcatgtgaccagctgttctatactggcgtattttttctttgaaacatgtcctttaatttgctatgatgtgtattttctggcctagcgtatgctctccagcctctagggggagctcaaggcttcccctactcaagcctcttctatccaaccccgggaagatagaggaggtctccaggagcctgaggcatagtgaggtacccagggctgggcggccatgggggccttaaagctattatgaacagaacagaactgaagcaaattttccctcggccttttctcctgctcctttctgtgtatagtccttgacccctcttttagaatcagttgctttcttggcgttttcctcttcagtgcatgtacatatttctgttgctactgtccttgtccgctacattaagaaggatctagacagtctttcatctgggatgcaaagatcgctcatagcctacttttttaagaaaagcagaaattattctatatatttatttgcacaagcaaaataataataataaagatatatttttatggtctcataatttctaatttatttttttaaaaaggaagctacctaagtttccatcaatagcatactggttaaataagttaaggtacatctttgtaattaaatactaggaagatattttaaaaataaaacatgcatatggattgataaagttcttcaaaatatagtgttcagaagagagaaaggcaagatgcaaaataacctctctctctctctctgtgtgtgtgtgtgtgtgtgaataaattatccaaatgatcataatgagaaacatttgtctacatatgctagagtggataagtacttaatatgtaataatatgtgagaaaatgataaaaaacagttacctaagtggaataaaaactgagggaatgacacaaacttttgctttttaccccatattatattattttatttattttccctgtgtacatattagttttttattttttttaaaatgggattagggtaggacctaagggtaaggaggctgagataggtgactctgaatcagcagattctttatctcccaaatatatcacagtgagctgggctagaatatgtgtgtgtgtgtgtgtgtgtgtgtgtgtgtgtgtgtgtgtgtgggtgtgtatgtatatgaaatcagatagggatttgggcccaaactagaacatgcacctaccactactagcactattatttatactactactaataaagtaacagcaataaatttaaaacaataaatgtatttaatactgataataaattaatgtaaagcaaaagaaacaagtatttaaggttgaatacttaaactaaaatgtgtaaaatactttactgctttttttaattgtgaaaggagaaatttcacaaacaagtccattttaaccaagttgcattttgaccattacaaaggaaatggaaagtccatttaaagtaggacagggctagtccctgcttgtggtttcatattggcttcctaataaactgtgacccattacaaatgagattgagctggctttgtgctttgaaattttttttctcaaatgtctggtctccttagatttttgagccctgttttgcttttgctgtccatgaggttttgaagttcattgattttgctgttttaaaatattgcttctgaatgggggtgcttggggagtgaggactgactatggaagccaaaggcagagagatgagtgcagagacatttacagtcaaggccagagtcctgatgtggccttgccctaaagctgtgcccagcctaatctcttttccatgtgtagcctcactggggaactgtagcatctcaggctttctgaggaagcagacactacaatgagaacccaaatcctattcttccagcagagctcaatcattagaagaaaatggaatgtggaaagcatgtcacatacctaacagggatgctttgcttaggcagccacagccaaaagagtcacatcttcacatcagtttctctcctgcatgtgtggcccaggagttgctactcaataccacccctggagaagagcatggcatggaaccagagctaatctagggctttcatttctttattgcctgcagattccttccctacccaggcctgagacagagtctgtagggatggaatacagatgtgagggcaagggctcccatatcctggtatacaaagctcagcctgatggtctacataccattactactcagtggttcccagggctccctccatagatgccctgacaaatggtttagtgtagagtgatgaatggtgacattcctgtccactgggttggtgtttgaatctctttggtcaaaaacaaagttggttctagccatataccagaagtcttcatccttcaagatttcttatttggaatttagaccatctcttgtcataaaatttacactattacaaaagaggggttagaaccacagtacaacccagaaaagcagtttgagttaccatattttataaatgcatagctaggcataaactgcaagcctgcaatcaaacagccagcttcagaagctctaataatccctgtggtctagaacaaaatattgaattttaatgttccttctgcaaaaatggggttagtaacatcaaccctctgaaaccactgaggcaattaaatcagtggatgtacgcgaaagtgcttggcctagtgctgggggattgtatttgaagtatacttccctgttgcttccaaaaattcctaatatactgaaatgtcatacatacgtttaactctagctgcttcttaagtcaccaacaaaaagacagtgttaagaacaactttttgtgcttgaaccaatttgccataagtaacatcttgcaagcccccagtgccaactgacttatcactaagctcatcccagatgagactttgcaaatctctatttataaaatgaataccttgctgctaacttatattgggagggaatttcacttgccttcaaataaatatgctgtcagtaattgctgtatttccatttccatcattctgcaagtctctagccaaaaggtcacatgctaacttggtacgtatgtatatatgttgggtagaatacttgctccagatgatactagcactggatcttggggcatttatccgatgtctctgagcctcaattttcttacatgaagaataacagttactatatttactgcaaagttctgttgaaagattaaatcatatgatgcatatacacgcctgggccatatggcaattattactgttgttcttgttatctacgacttcatgagactttattttcagcatcatgaaagatgtgactgactcctacttctgtttgatcattctcctttcccatccataccaaaatgaatagaataataaaattacgaacatttaaggtagatctttaaaccagtgcaatatccaacacagagcattgcatgtagtagaattaatgaacatttgatgacaagttgagtaaataaaacagtccatacacccctcagggttttcagtcttttctagaacatcattaacaagcagtcttcagacctatgtctgaatatccccagcctccagaaacttaaaactacttcaattgcatttatagtgggtttaccaaatgtgtgacttgtgaagccatcttctaaccctacacctacggcagtttacacgcattgataagggcaccaaaacaggatcacagaatccttagctccagctagattaccaaaaaaaaatcagagtactcttcatattagagaagtctgtctttcagtgagtcatcatctatttctttctacttcttttcttgtggccctaaaagccagacagaaatagtctgattgttctcctgcatgaggttgcttcagagagctgcaggcagcttctcagtgtttcagatccaccttcagcaggaaatattcttctgcaaccaccacacacatattccagagatgtgaataagaaataggggagttcttcacaatttgttcatgaagagggaaaaggagaggcctcttggtctctgagctattattaaaataaatatcattggctaaaaggccagaaaaagtttcgggaccacacaggcaactgacacttttccaactctaccatatcatcactaattggatatgctaacactttctgtagcatttcataaaaaatgtttcaagaccaagtgataagatgtctaaacaagcttgtctttggatgcttgctctggttagttctgaggaaatacctacaacaaaatagcaaaggatttttctctcctctagtcccaggtgggtaattttctctccccaccccttctctcagtgtgtgtgtgtgtgtgtgtgtgtgtgtgtgtgtgtgtgtgtctccctgcccctcaatgggaacacagtcagattttgctatacttcagaatcatgaaacctcttgaaatagccatagttcagggctgaagtgtcaaatccagagagcttcacttgaattttccttggattgaacacttccccagagagatacaaaattacaaagatcatgttttgtggatttacttcaggttcagtcagaatgtgttgtaaaaggttaaacttattttttaatagcaacagtacccatctttcagagtccagagacaccctctatttctgcctcaagatttgccttcttgaggcagaaatagagggtgtctctggacttctgaaagatagatactattgctatctgtaggatcatattttcagaaagaagtcatattggctcaaatttgcaaaaacacaataggcattttaatgaaattgctgaagaaaaaataaaaggtgcctacatgttttgtctacatcaaattatgtgctctgctctggaaaactcaggtttcttgcctataaaagagaaaccgtctattgcatttattgtcccatcaacctcatcttacctatctaaggagataaacagccaatgcttacaccttccatagctactcaaagcacttggccttgaaaagttgctgtattcatttcctgtttctgctcctacaaattaatgcaaacttcatggcttaaagcaacataacttgattattttactgctctggaggtcagaagcctgaaatggatctcacatggctaacaccacggtgtcagtagtgctgcatttcttctagaagttttaagggagaattgagtttgttgcctattccagcatctagagatctcctatattccttggcttgagacccctttcttcatcttcaaagccaacagaacagcatctccaggtgctgctgtgtaacctccttcttccacttataaggacccttgagaatatgttggacccactgtgataatccagggaaatctttcatctcaagattcttaatcacctctgcaatgtctctttgaccatgtaagataatatactcagatatattttggggacgggttttggggactgagacatggacaacattgaaggacagcattgctacaaatgctaacgtaagatcatgggctggacctagatttagaaaataaggcaggcagatgaaggagagagagcctttggcactggtgaagaacttgccttttgcctggctccttattttgtcatcatagagtccaagtaaagtggggagaggagtcccatgtctaagatatggaaactgaaattgagagagtttgcatggtatttccgagactcacagttattccaaggagatcaaaatcgaagctctttccatagcactatgcccctggctacaccacaaatattacatggcagatgtgtttagcaaggttttatgatgcagagccagggctctgcacaaatattaacttacagttggtgacttctcacagctaaaggttattcctcaaaggtgaaacttacttcatgaaatagcttttttctttagtgggaagtaagcaaaaacatttttgtatttttggctgagccaaaagaaatgctgtttcgaaagagtaagtagttttcacctgtgcacactatattacatttcagtactttagaggtggtttttaaggaatatccaaaaaaatcaaaaggtaaaacgttttctatatggaaaattattttaaatcttttaaataagaggttagtcaggggtgagagaaggagtgtagagttaaataactggtatcctattccccgtgccttgtgtttctgagccaaattgtattgagttttaaaagaaagagtcttggcatttccacaaaatttgggagaagggaaaaacatctcatagaaatgctgctagaataaatcatacttggagacttctggccagagagagcagccttctccatccaccccaaattaggctaagaggttttctttgaaataaaatggacctttgaaattctgaattattagagtaactcaaactacatatttagaattctgagtaaggccaacaatcatttcaggcttttttttttttcatttttctgttatacaatatggtcttctgcatcattctgggaagaggcgtggtagatgacattttataaaaacttattttgctttaaaagctttacattttgtttcaatgccaaattcaaatttgagcatctgagaaaagcatctcacttctgaaagttattgatgattttacaaataagtcaatatttcactgatttcaataataaggctgaaagtttgattaccacctggcccatttgctacacaacattcagcttattcaaaggccaaatacaaatctcattaataaggaagaatgcatattttaggtgaactattttaggtagaataaacttacgaaagcgttagaaagattaaacctgaggagcttatgatcacaatctataatgggaaggaagaaagagaaattaacattttaaaagtatcttctaatttctcttattatttctgtgatccttacaataatgctttgagatagataaaaataaccctttacctaaagaaagtgaggctaagaaagcttaagtgacttttccaaagacacttttgtaaggagatggtcaactttagaagacctcagcttccaaaaatatcaagagatatttttcactgcccctagcacaaatatattcactctaccctcatcagagatgtgaggttaaaatccatgtaagtacaaaagccttttatcagtttctttacttgttacattggaatattccatttgaatcaggtatgtttccaggctggacgtgaagtgatgtgaaaatacagtgatccgcaggtcacctatgcaagggttcaccactcagctggtagttaaaatgctgtcactctcaaatcttgtttggctttcccacatgtacccatggtttctccaacactctcagatgttccatccctagcatttgaattaatatgttcaaattgattggccatatgtaatgatcaatttagttaatgtcgagaacaccaactaagagattatttctatctggtgccaggtccacctttgtgcatgctgatagaaacaaggaaggtccttctgtagagagaaagtagatcccagaatcagaaaccaggaatgcacattcctacattccttatccttagagatcaatgctatctcttatcatatacatattaaactacaatgcattagtattaggttattatgcataaataaactatatatttttaaattaattacactttttaaaatctctttaagccatattatacatatagacagtgtattaatttgtttgggctgccataacaaaataccagactaagtggcttaaacaataactttttttttttttttaacaattttgggggataaaagtccaagatcaagttaccctcaaggctgacttcttgtgaggccactgtttctggcttataggcaaccatttcacctctgtgtccccacatggcttgtcctctctgcatgtgaagagagagagagagagatctttggtatttcttcctcttcttacaaagctaccagtcctattgggttagggctccacctttatgatttaatttaaccttaattacgtccttaaagaccttaccttcagtcacattgagggttaggacttcaacatacaaattgacaaatttctgggctggcggggggaacaattcgatccatgatagatagatagatagatagatagatagatagatagatagatagatagatagatagatacatagatacatagataactaatccttatttggctagctaggatggatgtcctcctacaaaatttgctccatgacattaactctgttgcctggacattttactttaaagggtacgtgagatgtgactaataacccctatttcttggagttgttatgaagataaataaatgtatttaaattacttttttctggctgattgctactaataattatgattcaggtaaagtatcacctcttccaataaatgtatcttggttcttgcccctgctaaactggaaaaagcaccttttcttgtcttttttattttttttgagacagagtctcactctgtcacccaggctggagtgcagtggtacagtgatgctgttttggcttacttcagcctccacctcccgtgttcaagcaactgtcctgcctcagcctcccgagtagctgggattacagccacgtgccaccatgcccagctacaaagcaccttttctgtgaacccttcctcaatgtttacactacatcatacatcaattatatcattaaactataagctctttgaaagcaggaatagaatgtaattaatctccagctcttcagcaatcgttacaatctctagcacaccatccatattgaatgaataaatgcaaaatacctagtactgtacctagaatgtaatattaatgcaattttatgttcagaaagcactaaaaattcagtaagcattaactactaaaaatattttagttacttaaagttatagaaggtttaaaaatgattaaaacagtgggtgtgatgaatcttatgtttcacttttataatgacttgttatttttgaaattcacagcttggatagtaaaagaaatgagagagtttcagttccagtactttccaggctctaccacaacattgcctaatgcagaattcatttcagacaattctccttttcgagagttttcttgaccacccccccccccaaaaaaagtaaaggttattttttcctattgtcactgcttactagtcttgaaacattaaacattatttttggaaatttaaatgggaggttttggcccacagaggcaatgtccgctgtccagcaggactggctccaggaggtgaggcccatggctgtgtttaaatcagcaatccaagcccagaaatattctcagcaaaggggcagctctgggcataccctcttaacaatctgtgtcttttcatggaaaaatcccctttggatcttatgatatatttattgactttctttccatgtgaagggattccaaatcttccaaaggaatctgatggcctcaaaggatatattcctacctgattttccagaaagttccatagactcactcttaatagatatacccagggagattaggtaactgacaggttccgaatgtagttaagttagcatttttcccagttacaagtctaggatcccatattcagaaaagtttgtaccatttagcaatgagaaaatacacctgctaggttcactgtggaattctacagctttaaagcgcagaaggcggagattcccaatctgggctctaaattggtgtcatccagagagatgtgaaaaatattgataccactccagagattcttatttaattagtctagcagcctgggtatcaagactttaacagctttccaggtgtttctaatctgcagcctagcctaataagctctgctctgaggtctggaactgtgtttttcatccctggataaacactggaatctggggaacatcccaattctcatcccttccatctaagtcagtgattcttatactttatgtcagaatcatctggagggattcttaaatacagattgtgggccccaaccccagagtttgtaatttggtatatatggggtagggcctgggaatttgcattttaacaagtttgcttatggatctgtggttacaggtcctaggacccacttccagaaccactgccaaagatatgatgtatttggttcagggaactttgtcttcctagactgaaaaatatccgaaatctatacctaagtgctattaccaattactcaccctggcattgcaatggagattcgccatgactccagtttgagtagtgccttaaatccctcccccagggctacccagggtagtgtcgtatagtggacagaacacaggacaaacttgctttccactcctgtctgtgccccttagtagcacataactgtaagcacgttgttagccttgggtgatcaatttaccctggtttatgtagacctttaccagtttaagcactgaaagtctcacatccttggaaaccccttagttcagggaaaacctaaaaggttagtcattctttggtgtttccattgttgtttaaccagtggtaagaaaagccaagttgactttgaagagtcccttcaagcatttgagatagtacatgtaaaccaccttgtatagagcagttgcttcataaaaaataatcgtgattatgtctatgacatattttaagatggattgtgtagggaagggaatgacatgtttaatcaccagtatacatttgtagtgaagatcatgcaaagcctttggtttggctaatgcttttagagcagtgggtctcaactttggctgcacatttagatcacctggggagatttcagacaacctcctccaaatacccaaaccacagcccagatgattaaatcagaatatttggtgttgtaactcagacatgagtatttttatgagctccctaggtgatttcaacttgcagccaaagttgagaccttctcaaggtgtggtccctgactggcagcttcaacatgacctgggaacttgctagacatgcacattttcaacactctccccctccctactagtataattgagatctttggggctgaggcccagaaatcagtgtttatcaagttctcccttgcacactacagatcacactttgagtaacactgaaatggcactttctgttgctctactaatgtgcttatatttattattggcaaatgtcctctctttctagcagcactagataaaccttttttatagaattattttaatatactatttggttctattttcaaaatttttacttagaatttttgtatcaatatttaaaagttgttttgacttctagttttgattttgtgcaatctttcccacatcttaatgtctatgatatcctaacttgataaattaattggaaagcttttcttcttattttatgttttgaaccagtttgtataaattaaaattatctgttcctcaaaaatttgtaattcactggtgaaaacacacttggctgtgtcaccgttgttggaagcagatttcttttcacagtttttttgtccataaacattatttctaatgttatttttggccacctatattacctagaagaccatccaccttgaaatctttttttcaaactgttggcttaggaaataatactatgttttcttaaattttttttttaattatttcaatatgtgtgtctatgtctttttccaaacactagaactgaatgtttagtgcatgaatttaagttatgtactaaattttttcgtttatatttaaatacttgaatatatgaatattcctacgagaatagctatggctgacatccataaattttcatgttatatcattatgaatttttgctttttagaaggtgctgtgatagataagcaagatctaaaagttctttgagcaatggaaaataagacatttctttgttttcactgcacaggagatttacatatgaatatacttcatgcttataagtgaatatatgtatatcgacctgcaagaaatcctctttccttgtctattctctaatttttaatgtattttattagtagaaaaatgattagcaaaattcctaacctacaataaaaataaaagaatcctccttttttcaattaaaaaatttaaaacctttgttatttatgttgcagaaatatttgctttttaaattttaattcgcatatgtctgatatattgaaatcaaacatcttgttatttactattttagataaatttttttcaaaatttatgcatgctatttgtagaaaattttacaagttatattagtctgctttcatgctgcttataaagacataccaaagactggagtatttatttaaaaaaagagattttatggactcacagttccacatgccttgggaggcctcacaatcatggcagaaggcaaaggaggggcaaaatcacatcttacatggcatcaggcaagagagcgtgtgcagggaatctgccctttataaaatcatcagaacttgtgagacttactcattatcactaaaacagcatgggaaagacccacacccatgattcaattacttcccatggggtccctcccatgatatgtgggaattatgggagctacaattcacgatgaaatttgattggggacacagccaaaccatatcacaagtatttaaaacaattttttaaaaacaccacggtccccacccgttgataccactactatttgggataaactctacttattcttctgtaatctagttatctctatttgactaacagcgacccaagaaaaattcagaatattaagtaaatttcttatcacatatttttaatcacttcagtgcattttatattatggatgttgacattttaatcctgcacatataatatatattgtttttaatttttaaatattttaaataatgctgcaatgagtgttcttatgtattcatatctgtgtacacacattctcttagaaaaaaagtgtctaaaatggacaatcactgggttaatgaatacaaaacatactgataaattactgtactgaaatatctttattttagctatgcttcttttaaatagcaaagagttgcagttttatattgccccaggttgaaaaacagtaatttgctttgtatatatttttccaaagtacttttttccttttgttgttattggtttctgactttgtttttgttttagtgtttgcccattttgcattttgtttcctttcctttgtgattctgtattgtttgttaattagaccctagacctttttatcatctcataattcagaatatattttatttcaagtatttatacatttaaactgcagcactttgccagctcctagtccatacaaggaccaagacagctgctgccctagttctcaatctggccatgaacttcttgcatcacaatcattttggagcgattattaaaaattcaggttcctaagcccaaccatgaaaccagatgaatcatagacacctagagaatgtggcccaagaacctgcatttttgtaagtatcccaaataaatcttggacacatggaagttttagaatctctaatttcaatttttttttttctggcagaacagacaaagatcacaccgaggaattacagataaaccccattctaatggtaagtagcattttcagtggttctattgtgctccgattacttatctgaattaaaattagatggatacttgggggatggctaaatggaaactctgagcactgtttctttagtggcttttaaggatattctgtgtcttcttaatgaacctctgtgaatgacctcagtcctgaggagaattaggctatttcaaaccaaccactttccttacttttcccaaggactaagtaactattagagcagacattaaaccgtaaccaccaccagctatacccgatgactcaactcaggttataattaggggaaggaaacgccagtgggaggctggtggggctcagaggaaggcagtttgctggaatgaggaatgttccgggtcttcctgcaaaggacagctggcccttctcagcggtcagcactggtcagtgtccacaggcactgctgacatccttaagccacctgggcccttaagtgtccagaaatacctgagtcttagaaggacaaacagaaagacacccagatactacagaatatttttaagctggatgatcgagacttgtcctgtaggtagcatcaaaggggagaagtgatagacccaggatttctagtgtttgaggagattcaggaagaatgaatggtttttggagctaggagtagccctaggataagaagcccccaggtatagcaggaacaattatggagttaaaaattagaaagtgtctaatttctaagacatttcatgttaaataatattaacataacgttaactcatcagaggtgggaagattgggagtttggggtgggggatggtgcaaaagaaaagtcctggaaagtcctcagcaaaatgaaaggcttccatcatctaacctctgctcatttctccagctttaagtccctataagctctctccctatagactctccctataggctctctctctctagaatttttcttgctataggttctctctctagaaggtctctctctataaaaccttcccctatagggtcactccctgtagactgtctcccgataggatctctcgctatatattctctcgttatagactctctccctatagactgtcttcctagatatctctctataaagtctacccctatggagtctctccctgtagactgtctccctagaagctctctcactgtaggctttcttcctagagactctctccctcgaagttttctctctatagggtctctccccataggatctctgccacagccacacttccttaaagtccctgacaacacctgttccctccagcattatactctttgttgtactattccttcaacctaggctattttgtgtttacttaccattgtctctaccctgcttcgaagaccaactctactatgtatggaaggtgcatgaatggacacttccatctagtttggtgaatatcagactcattaacaaaaaagtacacaatgtctcatcattacatatatgtttttgagacccaacaaggattttagttcatatcaagccataaaatccagtttttccttcaatcaaagaggatttcctatcctcaaatactattctaggtttgaataaatttcccatcactttcaggggaatgcagtggaaatacattcccaatgtgagccaccttggacgctgtcatgaggaaagaggcctgtgccttttaagggaggagccaggatggactggggacagtgaacacacagagctgtctgcctggagttggggccaaagcacaggaccttcctttgtaaatgtgtctttatgaatttgtgtcaactgttccctgacccagaatcacccagttaaacaaaccagggattaccaaaaacctcacacaaaaccaaacctgccaggccctttataatccttaagacagtctctacctgtttacattcatttaggctctgataaaatggtactgaaaaagccttccttccaagactctcaggatgcagggattagctcagttttcccttcaaaatgacattttccaaaccatatgagcaaagtttccttttcagtggcccattgaattgcaaaagaaaccaaccaatggtccatgtcactcataagctattctaacctcaaatacttgccccagaaatcatggctggacaaatttgaaatacccaaacctggattaagcctgtaagcttcaattgacttcaattcaagcccagctccttagttttatcatggatgacattacatcactgcattgcaatgaaacatataatcagaaagccagactctactttcctctggggttttggaagagtaattcctttttaggggcaaaaatgtgagctgtgacgaccttctttatattgtaggtcaagtatcaaaccaagcattcatccttttaaagagaggttgccagggaatcaagtcaatgcctcacttgttgacttattctccaccacccaaataactgctcgggcagggtcactttccagaaattatcttggtgagcaaacccctttcttttcccattcaaccttattggaaagctcaggcatgaagagacagacattgagagatcaagtttcagggactgtcaaggtaaataaagcattggaggttgggaatataagaacccagtgcctgggtaacaaggggaatcagaaattaccttcaggacatgcaacctgggaacacagcacaagcctcagattagaatatggacccggagaaacttgtaagcacagtacaatagaactgaagttggaggacacaaagtgagaccgtaattggggaagaatcagatggtctaaggaatgaggtgaaccacaaacagaccctgggagatccaagcttttctggatgtgaatcagccaactccttccagaatcccagctcagggccaaagcaggagtgtgtgcctgggcaggtctgaggccacaggtttgagcatgtagacccatgcacaaggaagacaggactctagggcaggaagccaggctcccaatacaagctcaggcaacaactgctcccttcccaaaatgggcatcataaagccaggtgaaaacctgtcatcccaataatccttcatgattcgcaaggagagaaggtgtttctacaatttagtatgaaaagaatgttttaaaatatgcaaataattccactcacaaacagttaataatttataataatctttatttgctaataatttgaatattatgaactgcagcatactgcaaagcatactgatgctcttctctaagaactatagatgtattcctcttggagttgtattttattttacttcccagaaaaggagccactccattaaaggatgagaaaccggcagctccatgtcagtttttcctgtcaacaggagctagcagaggttttctcatttgtgaatctagtttagtttaggtcaataattagagacatatataatttaggccaggtactgtggagctgctagaaatgtaaggatgagctgacgcattctctggttggcaaatcatagccattggcttgggcaagtcattgttgaacatctgtggcctccattgtacctgccctccctttgagaaaaataggcatctttcctcacattgagacaggagcacattagcaagggaaaatgctgacatgtatttcctacatgccaggctctgtgctaagtgctgtacacatgttaccccacttcaccctcatccctgtgaagcaggttgccttctgtttaccatgtttttgtcactggtgcctaccagacagcctgatccatagaagagtcaagaactatttttgcaataataaatgaatgagtaaaatcatagcatgccaaacttttcctacatgaaattttcagtctccctctaacagtaaaatttaaatactgatttccctattcagaaatgttaggaccagccatggtggctcactcctgtaatcccagcactttgggaggctgaggctggagaatcacttgaagccaggtgttcaagaccagcctggacaacatagcaaaaacccatctctacaaaaaatacaaaatattagctgagtgtggtggcacgtgtttgtaatcccagctactcaggaggctgaggcacaagaatcgcttgaaccttggaggtggaagttgcagtgagcagagatcacatcactgcactccttcctgagcaacagaatgagactctgtctcaccaagaaaaaaaattattttgaaagaaattttagtttggagacagtgaaaatatccaccaaaattttatatacgtgtgtgtgtgtgtgtgtgtgtgtgtgtgtatgcactagacagtaggaacagaagtcctagtcagctttccctctgtcatcaggtaaagaaggcagtgtatgtgaaggattggaagtggaaaacattgtgttgccatctgtcctctctctccgtccaaatacaagctcatttgaactcattagacctaccattcaatccagcaataccattagtgggtatctacccaaaggaaaagaaagatacctgcacccctatgtttattacagcaatattcacaatagcaaagatatggcatcaacctaagtttccatcaatgaataaatgggtaaagaaaatgtggtagatatacatgatggaatactagtcaggcataaaaaagaataaaaatatgtcttctgcagcaacatggctggaattggagggtcattaccttaagtgaaacaaaccaggcctagaaagacagatattgcatgttctcactcataagcagttgctaaaaaaaaaaatgtgttttcatggatgcaaagagtggaatgataaataatggagactcagaagggtgaggaggtgggagggaggaggataggttaatgtagtacaatgtacattatttgggagatggatatcctaaaagccctgacttgaccactacacagtctatgcacgtaacaagatcgcacatgtaccccataaatttgtagaactaaaaaggaaaacaaaacgaaaacacataaagctcattctagtaactgctacctgtttggcactgttctaggaatttcacatactttcagaaaaactagtagttttgtcttccttatatatatcaggaaccagatagatctatgtttcctttttccttgagtccaaaaaaaccatttattccagctgccttatacattaaagaacttctttcgaaaacattggcaggatacatcagaaggggccagtcctcagcccatacaagagtgaaagatgatacatgcctacagcagtgcaccataggaaaatataattactacatgcagggcacagaaaataatagcgtacagtgtgcagatcaatcagtgaaatgaagaggtacctagaagtattgctaggctgtgattaggaatgcagaatttgggggtaacctttgatgaggtaagatcaagaggacatagagcatgtgattgcagctatgttttatgaaatgtaggaattatattttaccctagatctcaaaacatacataaatcaaccgcagggctttcttgaacaaggtagagcccacagcctctctatgttcccatcttccagctagcggatagcaatagctaagtttaagtaataggagtgttctagtagagtttcctggaagccaaacctggagaatatgcagtttatataatttttttaaatggatattcaaggaatctcttatttgaacagtttaatcaaatgtcttatcttccacagaaattgatgtttgtaattcttacacaccatcaagagaataactcatcaatgtgttggctgagtaattcaaattataatataattcacttatatgttaacaactgttagatgccaggcactgttctagatgctttgcatgcattggggtaagctaatgactctgaatttcttacatgttgagttcgaagtacctgcggatttccagataaagattaatttgctattttagcacacactaattgtgaacctaaaatgagccaggcactattctaggcactggagaaaaagaggtaaaaagaataaaaagagatggttcctgtactgtaaaaacatacagtctagtaggaaagagagacccaaaactaattgtaataacatggggtaagctacactataataataaaaatgacaatggtgataacaattataaatgatgtaatttatttagcacttactctaagatagacattttatgtgaatgagttcattaaatactgttaaaaactctgtgacgtccatattcatatttccaaatgtataaatggagaaactgaggcttagataaaataagcaacgccacaaaatccctactgatcagtaacggaacttggatccatttgaccccaaggcttgtgctccctattgccatcctatattaccccaccattcccacccccttttgattttccagagttatgaatgcagtacaattaaggtgcagaggatctgggagccagacgagtaggaatagaaaggcttcataggagggcaaaatctgaatcaagccttaaaaaaataacttggcatttgtgtttgctaagctgtgaaagatgggtacaggttgcaatgaaatagtacggtaaagatttgggatcaaaaaaaaaaagtctgcttcgtttaagaaacagggattagcgcagatggaatatagggtatgttgaaagaaatgagagagatgtgactagagaaacacatcagaaccatgtcaccattgtcgcagaggaccagctgcgttaaagacctgtgattttatttcatagagatgatccattggctcttttttttttctttctttcttttttctttttgagacggagtttcgctcttgtcgcccaggctagagtgcaatggcgcgatctcggctcactgcaacctccgcctcccgagttcaagtgattctcctgcctcagcctcccacgtagctgagattacaggcatgaaccaccaccacacccggctaattttgtatttttagtagagactgggtttctccctgttggttaggttggtctggaactccagacctcaggtgatcctcccgcctcctcctcccagagtgctgggattacaagcgtgagccaccgcgcctggccgaaccattggctctttctaagcagtggaataacaatggttcataacatttagaagatggggttatacactcaccagatctatttccctagagcctatttcagtatctgatacagggtagattttaataactgttgtcaactaataaatatatatttttaaatacattgtcagcaatgtggaagatacactgaagaaggaaaagactagtggcaagatataagccaggtggtaaaatctaaaagaaaagtcagtgatagaaaagaagtttgctgagaatgatggtttccagcttcatccatgtcccatgtatacatatgtaacaaaccagtacattgtgcacatgtagcctagaacttaaagtataataaataaatatgtgtgtgtgtgtatatatatatatacacacacacacacacaaagaagttgatatgggagagacatttgaggtagaattgacaggtcttggagacagcatgactgtgtggtctcagagagagacactagttgagaacaactcccaaaattcctatttgtgtgtgatcctccatgggggatacagaagggggagtctagtcggggattttgagttccagttgcctttggaacatgactgcacagatcgcggcctgaaaggaagtggcagagaagaaaaattcaaaatggctgccaatagtttgccctctggaggcctcagagttccgggggccatggatgcatggccacgcagggtgagcaattgtgatgagagaacagaaaggaaatccaaataagagaactcaaagcagagatgagctaaaaatcagcaacacgaaccatcacaagtgggtagttacgctcggcaggagatccaggcaaagcgagggcaaacttcttagccttttcctgtggaaaatttataaagctcagattggagaaaacgtactgatagttttgaagctggcattttaagttggaatgtcttctcaaagtagcacataacggcacaattcaataactctgaccattgtggaaaaatgccatgtgccaacagcgattttccataattttgttcagaaaatctgaaagaaatgcaaaaaatggatttgcagccctggcagcaggcagagaaacagtagcagagggctgcaggccagtaattgatgtttcaaatatcactgagtgctttgcctgtaatttcaggggagaatgataataattaaaagcacaaacttacaagtcatttctgaggaggaaaatgctgaatgcacttaaagtgaagggggtttgttgaaatgcttaagtttttccagcgagctttcagatatgcaatgattagttttatgttcacagagtgactttctcctcaaatgttccaaagtgccacaaaatggaatagattattaacccatgagattccctgggagccagtgatgaaactataaccatatgacattcccacatgttcagaccttacttgattgtaccggcctttgttacaaacagcacagtacactgtttaaaaggatgaaatgaaacctttcctccttctcccaactgacttggggctttactacgaggcagatttgagcttgagtctgcatccaccctttttagtgctgtgaccttaggcaggtcactctattcctctccacttccattttttcatctgaaaaatagatagaacaatagcacttaacatctcatagggtgaatattgaggattacctgagagtaaaacaatcaatataatttcccacttataatctacgctcaataaatattagctattattgatattattattactgctaaaatgacaaaggcacactatttttataattatttatttttgctgacagaatgtaaatttggccacagattgtctaaattttcctgatattttaaaacaaacaaacaaacaaaccagccagagattcaactgagcagcataaccctttcctgaaaggaatcccccatggttaaacaaattcagggactgagttttccatatcccagaccctattacccattgtattacaggccctggcatgcagtgagcactctataaatgtggagcacatatattgctgaatgggtaaacagttttatccctcctgagaagtaaggacctctggtccctcaccactttctgatgactaatattatgcttgtgcccacacaagttagctgtgacatctggatttttttcacgtgcaaactctctcctttccaagcactgaccaggagtgactttctgcagcttgggttgacagatgagataactagctttgtcttttcagacaaagctgtgggttgacagggatattgtaattaacaagtaaagtgaacacactaagcacatgctgcgattgtaatgcccaccattagcactgcactaaatagagtcgttttgtatttttcttcagtaccatccacctcttactggcctatcagagtgaattttgttctctggaccatgttgattcattcacttaggttttcacagatgtgaccttacctgttggctcatgattctgaatgtagactagtgaccagtgggagaggcaggacttttttacttttgtttttcctgctcaaaacaggatcttttatgtccccagaaagtaatttacacaagatagacctactatataaacagagagaaatgtaagttaggctggtggcttgtgtcagcctgaaaggtgatactgccttaaccagcatgacttggaggcagaacggggggagtcatgatgaagttgtgatgctgcttctcagctcctcctaaataatatgttggtaatgtggtcacacatggctttttgttcaagacacacctctacccaaatgcaagactaaagtctctcaaagaacctatggcattttgctaatcaaaaactctagatatggagttgggggaaaagggctgcattttatccctggaaactgcaacatgagtaactgaggttcactggaataaacagcacattcaaggaagttaaagacctgccaagaaacagtgaggcaagataagaaagaggtaccagacaatcttgttgatttcaatttgcaagcaataaccaatagattatttatttccagttgaattttccaagccaaattcagttacatcgtaatcataatttgtgtaaaaatgaaggttgactaaccacctacgatgagaagttaagaattaagaatggcaatgtatttatttggaaaaaataaaatacagagcagagctgcaagaaaactctcagaaaggtgggactccctggttggtctaccttggtgacttggtttaccccaggaacactcaaattagattcacattcctgggccaaggggtcaggtgtttccagttaagagtcaggatccttgaggtcttctgtagacatctcctttaaatggatgaccttaggagagggatttatccaaatctccatttgttaaagttatggggtttaaactactctcgactctgaaagacatatactaatggaaggaagggaataaagtacaacttagatagagttgcccaaacctggttgatatcagagtaacctgcacacattatttaaacagattatgagaactcactcaagaccaaatgggtacaaatctctgaaggaagggcttaggaatctgtatatttataaaagtaattctgacatgtggccagcctgctgtcagattggtatctgggaaaacattgattccctctggttctctctccaataaccaccaatcgattcctagaactatatgttagtttacatttccctgaatgttatataaatagaatcatatagcacatacattgtctagcttttttcacgatacatatttattttgacacctatctgtgttatatagaatgtattagtagttcattctttttattactaagtagtattccaccttatggattccagtttgtttatccacttatttcttgatgcacatattgttttttctcatatttaaactactacaaataaagcttctatgaatatttgcatacaagtctttgtataaacctatgctttcatttttcttggacaaataggagtggtatggcagaatcatgtagtggatgtatatttaacttaagaaccactgtgctattctccaaaatggttatactcgtctttatttcctctagcagtgtatgaaagttctagtccttccacgttatcaccagcacatatatagcagccttagaaacatcttacatggcaggatgaggagcaagtgagagacaagagagaagggttacacacttttaacaaccagatctcctaagaactcactcactgtcatgagaacagcaccaaggggatggtacaaaacccttcaggagaaatccaccaacatgatccaatcacctcccaccagacccctcctctgggggattacattcaaatgagatttgggtggggacacagattcaaaccatatcaggtttcatatataggtctataatcaattttgagggttttttttatatatggcatgaggtatgagtaaaatgttattgttttgtatataaacattcaatagttgcaatatcacttgctgaaaatactatcttatctccactaaattgcctttgcacattttccaaaagtaaattgtccatctttgtatggtctatttctggctctctaatcagtactattgatttatttatcagtctttacaccactgctacactgtgttgactattgtagcttcataatatatcttaaaagcatatggtattagtgcttcaactttattctttttctgagttgtcttgaatattttaggtgcttagcacctctgaatgaattttagaatcagtttgtcaatttttacaaaatgatccttcttgggattttattaggattccataaaatctattgctcaatttgggaagaatcaacatctcaacagtattgagacttctgacatatgaacacaatatgttactattttttgtcagatttagcccatgtatcttatatgttgaaggtgactattgatattattttatttatttatttctaattgtttctagtatatagacatacaattgattctgacattgttcttgtttcctacaatcttgctgaactaatttattggttcaagttactttctgtagataggattttcaacataatcatggtaattgtgaataaaaacaattttacttattcttttcaaatgactctgtttggaatttttaaatgtatcttcatgagggatattggtctgcagtttccacctcttgtactgtagttttcaagtatcagagtcacgctgcttcatagcataatttgggaaatgttctctccctttaaatgtgatgaaaaagtttgcatagaattggtattgtttctttctcaaatatttggcagaattcaccagtaataccattgtggtctagagttttctttgtgaggattttaactacaatttaaatactttactaactatagggataatttgggttatctatttatgaatgactttaataatatgtgttcttcaaagaatttctacatttattgtaatttttcaaatttactagcagaggattgttcacaatatttccttatcatccttttaatatcagtagaatcttcagcaagttcatctttcttattttttatattggcaatgaaagtcttcaatattttcttctggttactctggctagaattttataaattttactgatcatatctaagaatcaaggtttgtttccaatgatatttttctattgtttttctatgctctattttgttaatttctgctatcatatttatgcgtttacttgtttatttattcatctatttattctacatttaaatcttcatttgccattttcttaggttgaaagctggagtattgatttgatatctttcttcttttctaatataggcatttaattctattaattccccccaggtatttccgttgtggcattccaaaaaattgtgatatgttgtgttttcattttcattaagtttgaaacacaatttaatttccttttgatttcttctgtcagcttttttagaagtgtgtaattttatctacaaatatttggagattctttaaaaatccttctgttaccgattttagtttacttccattgtgttctgagaacacactttttatgacctaaatcctttaactgtattaagacttgttttggcataggatatgttctatcttgttgcatattctgaatgcccttaaaaagaatgtgcattatgctactgttgagtagagtgctctataaatatctattaggtcaagtggcttgatagtgttgttgaagtcttctacatacttactaatttcctatctattttattatatcaatttctgagagagtagtattaaaatccccaactatcaatgtcaacttacgaatctctcatttatgtccttgattagtttttatttcatgtgttttgaagctatgtttaagggcataaacatttagaatcatattctgttgataattcagccactatattgttataaaatgaacagtttgtttctgttaatattcttagttctgaaatctactttgatacaaatacagccattccaggtttctttttattagtgttaacatgttaacactaataaataataacacgttatatctcattccatcctttttattttaaatatttgtctttatatttaaagtatatttctttgtaagtagattacagtgggttctttttgtctatccaatgtgaaaactaccttttaattgggatatttaaacgatttaaatttaatttgattattaatatgactaggttcaaaactattgttgttttatagttgtttcatatcctctttcttttgtccactttttctactttctttgaatgaattgaatgttttttattattttcttttctctcttttattggattaccattagctacaactttattattacttttgctatttagtggtttcattagagattatggtatacatcttttaacatatcacagtctactttcaagtgatatcatatcactgcatgtatgatatgagtcttataagagtacatctaaatttctcttctcatgttctctagaatattgctataacacactttacatctacatatgtgtgtgtgtgtgtgtatatatatatatatatatatatatatatatatacacaccccaaatacaatctttttatttttgtttaaacaatcaattatcttttaatagttcaagttttaagaaaaaaactctatctatctatacaagttatatttgggtctttttaaatatcttccatatctcctcttaggtttttgaacatctggaatacagttatagtaactgttttgctgccatttctctgctaatactagcattttgtcagttctgggttggtttctaataagtttattttctcattttgttcttgctctttgaatgcttgataatttttgaatgaatgccaggaattgtgtgttttatgttgctgaatgctagatgttttttgtattctcataaatgttcttgaactttgctctggggtgctttaagttacttggaaattatttaatctttgagggtatggtttttaatatatattatatgggaccacagcagtgttcactgtagtgataactactctccaccactgagacaagacatttctgtggactctgccaaatgcctcatgaatcttgaggtttctggtcgggctgctaagaatagtcaacactatcagctttctaatccctttcggtggttcttttcctgacctcaggtagtttacacacacacacacacattcatctgtactcagtttaatatctgagggatgcctttttagatctctggagtgcttactctcttaacagctctttcttctctgatattctagccctcttgacctccctggattctctgctccatgtcctcttctcagggagcccaccaccctctgtctgggttcttccttcttatgtatggccttggatatctctgatggcagtaagctgaaacaatttgaaggatctcatccctcagagatcactgcccttcactgttggatgtccagtgtcttgcaaattattggattatataatctatatagtttttaaaatgtatttactattgactgtttcaggtaaaagaataaatccagtccctgttactccatcttagctgaacgtgaaaatataaagaattatttttatccccatttcacagagaagactaaagaccaaagtagactggttttccccaaggccacatgttgccaggtgtggtggctcacgcctgtaatctcagcactctgggaggctgaggcagggagatcacctgaggtcaggagtttgagaccagcctggccaacatggtgaaaccccgtctctactaaaaataaaaaaattagctgagtaatatggcaggcacctgtaaccccaggtacttagctggctgaggcaggaaaattgcttgaacccaggaggtggaggttgcagtgagcagagatcacaccactgtgctccagcctggatgacagaaggagactctgtctcaaaaaaaaaaaaaaaaaaaaaaaaaaaaagaaaagaaactcacaggagtgcactactgtatacatgtttgtttctatttttgtccttctagacattaaaaagtcagaattttccttctctagtttcttgggactttgctctggatgtacaaattaggcaactctttaggaagctaatggtccatctggtctccatttagaaagttgatgtggagtgtttctttttttgccagtcaagtttctagaactacccatcttaaaaatctttctttactggtcatttttcatagtggccacccaatttgtttctctaaatgagattcccatatttgtgctttatatctgcctatcctcattcaacaattttatagttcaaactcatctttttatttacccatatccctggaactacacaaactgacttctgccagcatactttcatatgagtcacctcctagttgctcactatcaatgttaacatacgaaaccggagttacattatcattttccccactctagtcacattgtgttacagtcaaattcacatgtaattttatttttgggtttccattgcatctgtctctggccttgaccttagaaggaaaaataattcttgatatttcatgtgtatttggtgcctgctgtgtcttttaataaaatttggagaagagtgaggagtagagattaaataaaggcagagacatcttctttggacgagagtgttcaatgttaagaaaaagacaaaacaaaacaaaacaaaaaaaacaaaaaacaagatacaagatccaagcatcaggggttaaagatttctacagtgaacaaaggcacctttggtaaatgatctcatttagcaaccatgactagggaatcacaccttgacttcacacttctctccttgcattcactgggacactgggccatgtatttattatgtccccagagaacaaagacttacatacaaaactgcaaacaactcagcaaagttgctaaaaataattatatttcagtagatgattctaagaaaggagggagaaaaatgtacttagcaaaaccagaaatctccagtagacactggagtagaactgaacaaaatcttatataaaaatagcatttgggtcccatctgaatttagtgataaggactgtaacaatacaatacaaatgtacctcgtgcagcatttgtcatctgactctggctctcggacactttatagcattagataatgcagttacatgggagatctaatagcagaggaacaggaaaattaaaagatttaaagtcaggtaggcatagtagtatgtcaaataaatttacaagagaattggtacactgacaaggcccagatgaatcaaaaattcatgtaagaaagagattattttaggatgacaagagctaggtccaaagagtgtcagaaagaagcaggaacaggaagaaagatgcagataccacacctatgcgtggaccattctctaatcacttcatgcaccccatcacattttgtctctacagatctctctgatacacacatcatcatcttaaccttacacaggcaaaaaaaattgatggtcagggagtgaatgcaaatttcccaaaagtcaaataacaagtgccagaggcaggatgcaagccaaatcttctaactgatggttctcaaattttagtgctcatgcggacacgtgcatgtacacacagacagaaacacacatctcctggggaggttcttaaaaactgcacatttccaggcacccctccccaaatattttgactcagtggatctgggataggagtctgtaagaggatcaagggatctgagggctgatgagggaaaaaatatgaccatgagaggcagtaacatacaagtttttttggtggcacttgcccaggatcacatgacaggggaagtgcctcatagcactagactatcagaggcttatagggaaggggccatcacccagaagagaaggagggacagggaactacctgaagaggggatatcagagaggggcttacgtgtctaagttgtgtcactcagcagcacagcggtgagcctctgggacagaaaaccaaaaggcaataatgggttgggggtccttgtaattactaggccccattttatcaaggtgtgagcaattgcatgagttttcttgggtcatgcaaagcaggtaggctctaaatagcttttaaaaatctacttgtttgggctttaaaaaataattagatgtgtaaaactcttgggtttggcactgtcaggcttttgaactcatttatatgacagagtgggaccacattcgaggagataactctgttgtggtatgttccagccacattttaaggaagaaaataatatttcaaactccaagtgctgggctctcttcattgtagcccagccaactcaaacagtggataagtatgccaggagtcagtgtccgtgtgagcacatgctggccaggcctcgggatctgggttaggatcgcaaacatgttttcttcatcttcatgaggacaaattctttttatacaagctggacttcttcaatcattctttatgaacaaagggagaacaggaaagctctgtttaatgaacttcccaatccagttaggagtaaaaagtagaatacacaccacatttggagcactttatgttaggattccgcccaaaatataccatagttgcatgaaaccgtaagctcactggtagctggaactgggtttgttggagggaccatcataatcactgcctctaaagcaaggcctttccaatgacagtagtgagtaaatgagcatggactaaataaagaacacaggaacatctaagttaccgggctctacatattcaagttgttgtgctgagaaatctgtctggagccatgaacttcaatcagttctcccatcgtccctgccagatgggacttcagtttctgtcctcaccacaaggctgagtcacaaacccaggctgacactgggaatgtggcatttaaactggtgcttaccaagcttataagagtttctttgagtgacccgggagaaggggatggtaagacaaagaaaaccactgattggaaaagggggcatgaggagtccagtcctcaattctcgtacaggtgggggtaaagagggaaattcaagcattcccttagtattttgcttccacctccctgttcccacctcattctttgtaactcaaatcagaacctcctctctctaaaatctgttccctggtacctaggaatcacaggataggaggctatttttttttatcttgacacaaaatttgccacctccaacctcaaactgctcaacccacagctccctccaagcccacccaggttttaaaatgtgctccaagtctcagcattgtggtcagacagtgcagcacctgctgctgagtttagggttctactcatctccagccctacccacctcctacccatgaaagagaaatataagagttctaattgcagttgctaatattgtgtttcataataaaaatgaaaacataatttatttttaaaggatgacctgcaaattttgcttcccttttcctcaatttgcccttgtgcaaaaaccgtggtttgttgctgtcctagttaactccttactgctagagacaggccctatctttcatggtaacacacacataggtaattttttttttttttttttttttttttttttttttttttttttttttttttttttttgagacggggtgttgctctgtcgcccaggctggagtgcagtggtgcgatctgggctcactgcaagctccgcctctctggtttgcgccattctcccgcctcagcctccccagtagctgggactttaggcgcccgccactgcgcccggctaattttttgtgtttttagtagagacggggtttcacgtgttagccaggatggtctcgatctcctgacctcgtgatccgcccgcctcggcctcccaaagtgctgggataacaggcgtaagccaccgcgcccggccacacatagataattttaagaccatgtggatgctctctattcctcatgcaacccatggaaacattgctaatgtgcttctttctaccacgttgcccttcctgtctccctctatcctctggataattcctggtcatccttttaacattacttcctaaacctgtttttccaaatgtggtccatgctctagcatcacgagcatctcttgaaagtatattaagaaacagaatctaaggcattactcccctgctcctgaataagagtcttcattttaaataagtctcagggggcttcatgtgcatgttagagttttagaagcatagccctagaagatatctttctagaaggagtcacacttattttctggcttccatttccttgttcatgcttcttattctattataatgactctaggaaactccttttctagagcaaaggttttctaattgcacctaataaattgtactcactgaaaatcataacagggtagtgaggtcaatttagtgggtcataaccaggtcttttaattaaataaaataaaataaaccactctagaatagaatggaaaatatcaccaggcaagtatagtttcatataactttgaaacagtatgtctatgtgtgtgtccatgtatactggattgtctacatatatttactgtggaccatgattataaaaacttgaaaccctctctaagctccttggactgagggactgtttgactcatttgttgtacatgtaacccctaacacagtgattatagagtagatgctcaaaatgtatggaatgctgtatgaaaggccatagatcattgggagtggcatcaatcattagtgaacatgacatccagtgagaggatgactgacagcagaagggaagaaagtggctggcctagcctggggagtaggagggaaagaggaagggcttaacagatctgagtccctttcttgaggcagacctgtgttcagcacctggatgggattcatgctaaccagatcatgtgccctttctaaaataaaaattttatatatttaaagtatataacatcatgttttgatatgcatacaatagtgaaacaaattacatatataagatatacatatatacatatataagatatacaaattaaatatataacagatacataaatgtatttatacagtcaaacaaattaacatattcattcctcaagtagtgaccattgtgtgtgaatggcaagaaccagccaatatctctgatgaatatcctcaaatgttaccaaactgaattcagtaatacataaaaaaaattatacaccatgaccaagtgggatttatccctaaaattcaatgttggtttcacatatgcaaaccaatcaatgtgatgcaccatattaaaaaagaaatgaaagataaaaaccactggccaggcatggtagctcacgcctgtaatctcagcactttgggaggctgaggcgggcaggtcacctcaggtcaggagctcgagaccagcctgaccaacatggtgaaaccccatctctactaaaaatacaaaaacttagccaggcatggtggtgtgcacctgtagtcccagctactcaggaggctgagacacgagaatcgcttgaacctgggaggcggaggttgcaattagccgagatcctgccactgcactccagcctgggcgacagagtgagactctgtctaaataaaaacaaaaaaacacccacacacaggatgctcttaatagatggaggtcaaatgccttttaaggaacctcagacttcatctggctgtgcaaatacccctaggaatgtcactaggcacggtagagaatggccactggcttgaaaaatactgaccaaaagtagaatttcaatatgtgagaaggaaattaagaattgtgtggggaagattcaggtttgaatcccaggtagaatcttacattgtaagatggcaaaagaaaggtcagtgaaagactttctggaaaccagaatcagatatccgtccatgcactccatagtcattgatgtaacatctactacgtgcagatactattctgaagactggcaatttaggtgtgaacaaaatagacaaaatggctcttctcatggaatgggcattgtagtgaagaaagcaaagaaaaaacaagcaaatatttcatatttgtatttatctttatattatgtttatattatactatcccaaatcctgcattttgtttatattatatatatatatatataaatatatatgtaacatgtaaatatataacatggtgatttcaggtggtcatgctagaagaactgatggaaagtgagagacagtagcacatagacccctctcttagctcccttatctgtgagctaggaaagattaggatgagatgagagccaccccaagaggaaaatatctaagattgattcagattttattaacaaggtttcactttatgttgaaatctggtaatctgttatcagagattagcactgcaatgctgtagaatggtcgagtccagtggcattaaaactttgttctgtgtagcctaagacatcacaactggtgagtgaggacaggccggagagactctggctgccttaccacaacctgtccctctagcacattgcgacttaccatcagctgcatttggggagatgccacgggaagctgtgttttgcaaagttgtcctgctccagaatagctctaatggaattctctaacaactttagctttcagattaagaaactgagatttatcagaattagctgacttgatcaagagcgcacgttgaagaaaagctaagcatagaattatgaatcatgcctgcttttcctgatctcagtcaattataaaacaacagccattctaagatttcttactacagataaaagtgttccaggccttgtttcccttagtaggcaggagagtgtgactcaggccaaggctcatttgccccatttgacattggcattacaattccttacctggcaatggaacctacacatacctcactaggagactttctcacgagggaaaaccaatagggacttaactcattggagttaactcttaagtccaagataggatatcgcatctatcctaccttgatacatcccctctgctctgaatcctggtcagttaaaatcctggcatatgttgttattttgttcgcttgctcaaagggtttccaaacttttgaacaccatgtgttcattcaaatgtactgctttggactcctccttcactctgatttcagccacctagatgatttttattatctctttactctgccacctccaaggaaaaattttccttctttgtgttcaaagtcatccagatgtcagtactttctctaatggactttgccttcgtccatccccaagtctcatacacaaaaagccatgtacacatttgcgtgtaccagccttggtaggtatcatctagttggaagcagctcagcaggaaatatccccaggcttccctcaggctgctttttttttctcctttgggggtacctaatttccattggtcctttgtttattggcctctgggtcatccactattaccaacttgaattgagacaatctgctgtgtaaagggtctaatccttgtctttgcatttactcttttttttccccatctaagtatttgaatacataggaacagatggaactgtttttagacacagttgcagaatttttccttgcagacacgcatctacacattctggtaaactagttgggtaacctgcttaacccattaaaagcctctctgacagccattttccaactgatccagagctaagatgattatagtaaggtctgtcccatgtgcacagagttttcttactttctcaaacaaagcattttagttgaagctgttccactggcttttctaatgccagcccacaggaaagtttctcccaaccactatccataaattctatgcaaccacaccagagatggcagctgcccatttcacagccactcaagctaaatctctccttaattcttgtctccaaatattgtcctcagttcttctggggttggagctagaaacatcacacatccccaaggcagcaacaacattcgtgtttactttagaatacattttgataagcacccaagtgcttcagcggaaactgaagggtatttgtgtgaggtagcagattgtggggaggttttatgtcccagcacactctggggaaaataaaagaaaatagctttctttcctggaagaaaagaaaaataaaaagaaaataaaaaagactaagagccagtgcagacacaaaaagacaagctaagggaaccccaacaacacaaattctggaaagaatggcacctcccctgtcccccacaaaaggctcagactccagaaaaactgtgctgatgatgttggaaaagcttatcgtgttattgggaactaacttccctttttctgtaggaggcaaaacccaagaagtgtaaacgcaaaaagtttctgcgcttctgagtggagaaagttccccaaaatgagtgtgaaaagactaggaacaactgaaaattccagcccacagtttcaagctttccaaagcctgtttgctttggccagcctttgccattcctttctctcttttttcagaagtgtgaaatgggttggttgctggtatttgttctgtggtctctgctaactcttccatctgtataaacttagctctgccaatccagcagtttagcagcactttctcttcagctagctcaaaaggacacgaaggtcctattaagtggccctttcaagacttgcaaataactgtaccatgctgtctgattgaaggcatgaagcttatttatgctgtccttgcaagggctggccttccttttaagacttgtagctaaacaggatgaaggcaaagttaatccaagtctggatttgaccattcctccccagtgtcagggaagcagccgaggtggctataatatgcctataagcctgagaaactaggcccggcacagtggctcatgcctgtaatcccagcactttgggaggcctaggcgggtagatcacttgaggtcaggagttcgagaccagtctggccaacatggcgaaaccccatctaatacaaaaattagctggccatggtagcgcacctgtaatcccagttactctggaggctgaggcatgagaatcgcttgaacccgggaggtggaggttgcagtgagccaagatttcaccactgcattccagcctaggcgacaaagtgagtctttgtcaaaaacaaaaacaaaaacaaaaaaacaaaacaaaaacaaacaaacaaaatcttagaaacttgaagatagggcatggtacttagtggtgatgtcttcctctttttcatgaacatatttatttgaggatgaagagagccatgggagaatctacattcccatgttttcccactttccttctatatttatctgtatttgggttgaccctcttcagcaagctactgtccttcaagaagcaataggctaacagggtgcccacatgcttttatctattctcaatggaacaacctagactatttaattaactgtttttcactagttgctcttacaaagcaaaatattgtcaaatatgaaaatttgccttgggtcagagaccgaatatgagtagagctgacggtttttgccaagtccaacaagtatctctgtgaagtgtaaacagctattaatgaagagagtagccacggttaaataaaccagggggtggagaacacatgggccaagagaagagctatttgttgcacatttcctctgtctaaggatgaatccagcctagttgggtcctcagtggaaggtaacagaaattttaaaatggaccagaataaatagccacaaagaagaaatggtgccccactgagaactagagccccattgtccaccatggcattaaaaaagaccccagttatgtcagatttaaagtcatgagctcttcactgggttctccaagctagagatggcaaaactttaacccagagcttcgtggagaaatttgtctttagtgactatacagtcagagtctatacagtcagtgagtatacagtcagattcattagcctactttatgcagatgtgaatctttctagacctgtctcctccttatatttctgatctagataattcgttaatctgctcaaaaccgagcaaggctggattccacaaaactttttccaaagttttgaaaactttttccatccatacaagtgggcaggtaataaacatagttcccaggattgtgttaagtaaaatgacatttatagaatgcacaatgaaatattaggaagaaagtaagtcctcaaataataactaaaaaaaaaaaatttaaaggctatgggcttacagtgatctggacccaatgcaatgctacaagaaataaaaaagtatatatttgtatttttaaggccaacctaatactgtatcagtaattccaaagaggcagacagaacctgtaaacacaaagaggaacgtccttttcttgggaaagctctccacaccaaaaaccttttcttgtcaaatgaagggtacagatacctaggaagtatttacatttgggagttcatgtagtggaaatttaccttgacaaagtcaggacaatgggaatcattgggaaacactcccaaaaggccaaaagaagcttataacatatgcttcaaaggacatacagttactttttcaaagggccatcagcttttgattctctctggctaattgaactctggactgctggaggaaagagattatgtatcccggtgtctggaataattaatagtgcatagttaatgcttaataaatcaggtccatgacttggattcaaatcttcactctgccactttctgcctgtggtactttagcctctcagagcctgaaattcctcttccattaagcagggagcttaatggaacaagcgccaatcttgtacggtgttatgagaattaaatgactctgagtgttgcatgcttagaggactgcctgacataaaggagtaatctgtaaataatatctagtattattattgtcgttaaagcataatcgtttggttagttatcactgaccactcactcttctctttcttgctaacagaactataacttgtcaaaatcaaatatgaaaattctatctccctttgattgagattaagtctggtatgtgactcagttctggtcaatgacatataagtacagtatctatttataaggtgctttctggtgaagccatcttgtaaagatttttctcgctgaagggagactatatattctatattctcatgacgatgtgatgaccagagctgcactaacctcttaaaaccattgtcaacaatgtttggcagagtaaagtataaaaagagcataggtaacatgagacttgatggcatcatgggactgctgcagcaacccatgcacaatccatctcctgccatctaattatatgagctccaagtctgttgcttccagcagaatgcaaggtaactgatacaatccttttgtgtgtagagtgtgtatccacataaatctacacacatacatgtgtgtgtagtgacatgcaaatgtctacaaggacatatactgtccttttattgtttaaagttttatatttaaattttaaagaattcaaatattgacagatgtacagcaaattatatcatagtcacctatgtacttgctactaatattaaacagatattaatattttgcttcatttgctttagaaatctatctgtccatctgtctcatttatgaaatgaaacattaccagttaagataacgtatctgcaaccatcccttcccttaggaaaacattactgtgaagtaagtctatatacttttgtagttctactacatgtaggcacctatagaaaaacatgcgtttgtatgttttataattttatagaactggtgacttgctgcatatatcatttttgaaacattactatgcactgagtttgatcatgtatccatgtttatataactgctttgttcattgaaactgctgcatagtactccatctgtatggaaaaaaatcttcagacaatatttcttttattgaggaatatctatttgttttgacattttttatttcaattttgttctttttttgttaatgtctcgaaactcatcatatattctagtttctactttgttgtcagttacatggcttgcaaatagctactcctagtccatagcatgacttttcagtttatgatggcttttctcttgccaatttttttataatttaattatatttattagccttttccttgttggtttggaaatttttcctttaagaatttcttcctatcctaatttggaaagaatttttaaatgttttcttctaaaatggtaaaagccttctttttacttttatatgtttaaaccctggagaatttattttttgtaagataaatactaggcatctgactttgtatttttccatatgaataatctaacatctcagggccatgagcgggatgtcccttttttcacagttgatttgctttgtcacctctttcacataccaagctcctacatacacgggggtctacgtggtagtcattagcgctcgtcacaaaatgtttctatttcctcatcttgtaggtacatggtaaatgtccattttctgacccttttgtgcacagtggggccatgtgttctgcataatgtgttatgaacaaaagtgcacatttaattgccagtaggaatccctccagagatctccttctctctgttagtgagagatgttacttgagcatcagcctggatacccaagtgagtaaaatgagcagagtccctctaacaactttcatggacttgcagcacagggaaaaaataaacatgtttattttacacttcagagatgtggaactgtttattactacggcatgacctggccccgtctgactgatacagagaaactggtacactcatgggaaaaacaaccaccaaacatggcatcggctaaagagctggcaccaggtgggagggagcaagaaattaggttgtcatataaactggagggatattgatctgttatccaaatgtgaaacatttggcaaaagttatccctgaaatagcttggaactcagaaatgtatttaatgaacttttagctcaaagagaagaatttggaaaatagaatgtaaaacaagtgtgttggttaacactggctttatttaacagagtgctgcaagaaagagatgggctcagaaaaggaccgactggattgcaaacaggaataaaagcctcaaagagagtccgtaagtataaggacttgcagcattgaaagaaacaactgcttctcattcacatctaataaaagatactggccagtcacagtggctcacgcctgtaatcccaacactttgggaggctgaggcgggtggatcacttgagatcaggagttcgagaccagcctggccaacatggtgaaaccccatctctactaaaaatacaaaaatagccgggagtgatgatgcactcctgtaatcccagctacttgggaagctgaggcaagataatcacttgaacttgggaggtggaggttgcagtgagctgagattgcaccattgcactccagcctgggtgacagagtgagactctgtcagaaggagaagaaggagaaggagaaggagaaggaagggaaggggaggatgaaggaggggaaggggaaggggaggatgaagaaggaggaggaggagaagaaaacttttcaataataagggccaactagaacttaggcttgatataaggatcaaatcgaaaataagacctttcttccctgggaatgctttcagttgcatcagatgattcagatgaatggactaagaatgtgactttacaactaaaacctgatggacttacccttaattaaacagacagaaggaaaagcaagaggagggggaggggaagaaggaagaggagggaagaagttattttaaagtccatgtccactaactggatcctctctgtaactgtttctatttccagttatttctctctctttttcttttttttttcttttttcttttttttggtaatgttgactttttgttacccacttatttttaattcagtaacattcattatatctgaaaaattatagaaaaaataatacttgggattaatgctttctttttccaaggaaaatttatgtttgcttctgataagcagctagaaggaataccaaccacagataatctaattcaagggattgagatactttgaaactaaactttaatttgtacaaggaccaactctttttttcctggttcattcttactcttagagggtagtccttctaaatcccaaaccagaccatggggggatattattaggggtccccatccttgacaggccctggacctccaaattgtgttctcagagttccattaggctataaaaagatctgctcagtttttcagcctctcagctgcctgttctggtagctccaagagctacacctctctgagtttctttcctctctggaatgttagccttgctatgcttcattttttaaaaactgccctgttcagctgttgtagttgttctctataagaggttgacctgcacgttatagtccactgtcagcagaagtcaacttttaatattcacaaggactcaatacagacacacttacaggatcatttttagattcaaagatgtctgataagcgaactaatatcaaagtggaagctgaccagtagaggtttctggataggaaaaggtaatggaagggaagaagagaaaagcaaacaaaagaatgaaagaaaaatcatacaatactttatggtgtaggtattctttgttttacaatgaggacactgtggtttacattaaaactgagctgctcacaatttatgcagatcagaggtgctgaagtccctttcaaattcaggactttttgactccagcctgtatttggttctcttctgctcaacatgcctacctggcattatgcctttgacctctgacagtcttctaattcctgaacgttgggagttaatctgagctctgggattcaactgaaaatcttagctattaaacttgattgttttatctctctccatacctccccctgactatacaagatacccctgttccagcaatactgatcaagcgaggctaactagtcttagttctaatctttattgtctcctcccacgttgttctcttccacaatgcaaatgaatacgaggaatttatagggtgataaggaggcagccttaaagattattaagtcagtgcatggacaatttctctggtctctctacaccacccttcctccttcttcctttctttacttctctctgtctgcctttctttcttctcttaacaaatatcaactgaacaaatgttgtacactaagtactttgctaaggacagaatatacagtggtgaaaaaaatcaggtgatttatattcacctggaccttacaggttaatgaccagtggtaggcataggttgaagctgtattttaaagtttatcaccctggagcaaaggtgagaatccatagaagaccaacgaagaagagaaagagcctagatctctgatggcacattttttagtactggagcccggctacagaactcagatttcctaaggatgtgcccgcaccttcagtgcaaaaatacagaggcctaggcattgcttcatgcatcctcattacctttgagtaacaatgtcactttgggttggagtgaccttgtacctgagaccccattccaacagaacctttcagctctccacctcccttggccacaaccccgactacatagacatgccagctgagggaaagcctgccagtcagaggaatctgcccttcagcatgcctagggttagggagccagaacatttgacccaggaaagagatccacccaagaccttaccagtgtaggtacttttttttttttaattctgagaacaagttagagccaaactgattaaatgacaaaacaagcattgagtgttttcaaaggtgtggatggaacaaactgaaatagtatctgcctcctgtctcctctccactttagtctccccaatggtaatgcccactctgaccgtgaaggcacccttgaaggcaagttatttgtggttatatataattgatcagcaaccataacttttagtctgatttagtcttagtgccaaggggcttccatttgctttcaaaaagaatctctatcctttgttcatttttcccccattaacttaccacagggccaagtgcaatgtaatcatatctcattgtaatcattctgctgtcaaagtgacatcactgcattcaacactatgtttgatgttaaaccatccactccatgtgggtttatctctttaatgcaggcaagacctctattgctagaagagaaacttcaggggaaggagaatatgaatttgtgggacagttctctcctggaagagaaacgggattctgggtgggaacaggggtggggcttgcaaaacttgtgaagcagagaggctagcttcctcagtctttgaggtgaaattcacgtctttataacttttgtctatttatggtggttgttccttctggaataatgtcaaacaagtttttgttcacccgtgacaacctttcagttaattaaatacagatcccttgccctcttttcctttccttgtattttctgttcctcaggttgaacacttcccattctttcaactatttctgatatcacattttggcagaaggaaacatgggtggaaaatattgtgggaataagtacttcatgtacacttcagtaaatgacaactctttctctaacctgaaagccaaacattctgacaccagatcagagcacacttagagtgacatgtcaacattccaaaccgcctgcctgtgaggggaaacaagaaaaacgggaccaaaatatttttgcctatattaattaagaaatgttttttcttcattggttctcatatggaactgacatatttttgtcactccttagaatgatttgaagtttcatattttaacctattaataaaactttccttaagattcatttgaaattactttaatatttaaaatacaactccactaatgtgttttagagcctcatggtctttttatttattttattttctgaaacaaaaataaataactatcctttaaaaagtctctattttctgaaactgtggaaccaagaccaaaccgaacactgaaataggctccacatcaggcacaaattaatatttttattgaatttttgggataatgtgcagaacatacatattggcattttgtaacttctgttagctataaaaataacagcacatccctacctttcttttctgacttgtttagtctgagacaaaccagagaagaaaaggaataaatttagcccttggcccactattaggtgggttctgagattaatcttgtacttaatcttttaatcttagacccgtactcctgtgctcatgaaaggtgagattaatacatgtactaatattactactactgtatcaacacagaaatagttgtaatgctactgattgcatgagagtaattttagtgttccactttcaattatggtggtgcctcttactttaagatagatatttttaaatcatggaaaaagccattaaaagtggctttccaagtcttctatgaaattgtatggtgttaacattttttaaatgtcctttcaaattttattgatgttattaaatattagaaaataaatagtatttaattattgttataattgctagaattatatatatatatataaattaaaacaatgttctggtggagtctgggaagttggcggtaatggtgccataactcttgaatctacccaaatcccacagaagctacatatcaaaaacttaagctcgtgggtatacagtcatgtacctgataaggacattttggttagtgacgaactacgtatgtgaccgtagccccataagattataatattttattttttctgtatattttctctgttaaaatatgtttcaatatgcaaatacttcccattgtgtttcaacaactgcccacagtattcaggacagtaacatgctatacaggtttgtagcctaaaaataatcggctataccagatagcctagatgtgtagtaggctataccagctaggtttgtgtaagtacattctaaaacatttgcacaatgacacgattgcctatcaatgcatttctcaggacatgtccctgtggttaagggacatacaactgtacaataaaatgattcttaggcaaccccatgaaactcaccaaaacaagaattggctgaaacacagagagctatagaaactgagtggtatcaacatcagtgtgagaagtagcagctggagacatagaaaatctgacaaaccagaaaataggagaatccaaaaatgttcccaagggactcactggaaagcacagtgtgctgattttataaaaaatgagttgtactaactccaatcgtgagtatgtacagaggtatgaagaattctgggcactgtgaactctcaaaactgtcccaactccccttgaggaaagatgcctatagtgatgaagagttgttgagcagatctgagacaactgagataaagaaaacactagctccagataaaagataaaagggtggagagggacagggccaagaaatggataacagaaatcaagctgacatattgcataacaacagaaatgagctttgtgaaattagagaaactatcatgaaccatggcttcttgcaaaagttcaaggaaaaaaacactaatttcacataaaaatgagcaagaaaaaacctaagtgacaacaacataactccctacagaaaacacatgtacaaaaggaacaaaaaaagaaggacaggaccacagcaaagacatgctatttctaaatgaggtaagcatattaaaaacatgacataaaatgaaagactaacatatatcacaactggaaaaatatcagaaatgaggtgtaacaatttaggaaagaattctaaataaaagaaaaaaaacttcagaaatgaaaactaaagtagaaggcatacagttgcaaacaaatacaacagataatggctgaagaaaaatataaagtgaaaaataattttaaaaaccaaaaaaagaaattgaaagataaaatgatttaagaaaaagtagcaaatattgaatataagcaaagaagattcaatagaggtataatagcagtctctgaagaggaaaaacaaagcaaaggaataacaaatatgatgaaaaataattgaggaaaactttcctaaatgttaaaatatgcaatttattttatgctaaattatacaatatataatttaaattacatattgaaaagaaaaagcacatacctgaaaaaaaaaatttaacccattgcctgactttaaattatactgcaaggctatagtaacgaaaacagcatgatggtggtacaaaaatagatacattgatcaatgaaacagaatagagaatccagaaataaacccacatacctagaaccaaccaatcttcaataaagtcaacacaaataaacaatggggagaggacacattattcaatacatgatgcttggaaaactcactagccatatgcagaagaatgaaactggatccctatctctcaccatatacaaaaattaactcaagatggattaaagacctaaatataagatctgaagctataaaaatcctagaagacaacctagaaaaaactcttctgaatattggcctaggcaaaaaatttatgaggaagaccccaaaagtaattgcaacagaaacaaaaatagacttgggacttaatcaaatgggacttcatcaaactaaaaagcttctgcttagcaaaagaagtaaccaacagaacaaacaatctacagaatgggagaaaatatttatattaataaattatagttacaacaaagaattaacatcccaaatctataagggactcaaaacaactcaacaagaaaaaataaccccactaaaaactgggcatgagacatgaacagtatttctgaaaagaagaaacacaagtggccaataaacacatgaaaaaatgttcaacatcactaatcataagagaaatgcaaattaaagccacactgagataccatcttacaccagtcagaatggcttttattaaaaagtcaaaaaacaacatatgttgccatgggtgtggagaaaagggaacacacatatactatcagtaggaatgtaaacttgctcaacctctatggaaagcagtatggaaatatcacaaagaactaaaaatagaactacctttcttctcagcaatcctgctgctgagtctctacccagagaaaaagaaattacataaaaagtacacctgtagtcctatgttgactgcagccctatttacaatagcagagtcatagaactgacctaagtattcaccaacagttgattagatgaagaaattgtgatatgtacacaccatggaatgctatgcagctacaaaatagaatgaaataatgcctttgcagcaacatggatggatctggaggccattatcctaagtgaaccaacataaaaacagaaaatcagtattatgtgttctcatatataagtgggagctaaataaagggtacatgtggacataaagataggaaaaaaatgactgttgacttgaaagggaagaaaggaggaggcagggagggttgaaaaattgcctgttgggtgcaatgtcccatatttgggccatgggtacactagaagcccaacccgcaccattaagtatgtaataccaatgtaacatataagcacatgtaccccctaaatctaaaataaaaatatatttttaaaaaagctaattctagttaaattactgggcttgaaaaaaataaacaatcattctgacatctaggcagaaagacaaaagacttacaaaacaagactattagacttctatcagacttctcaatggcaatgttttatgccagaaataaagatatagaataacatatttaaaatactgaaggggaataaatgagccaaagagtttgtgtgcatccaaacaaactaactttcatttgtaaaggctacagacaaacttccctcactttcaagaagtcaagtaatgtttccatgcactcttgctgagaaatctactagaaaacaatcttcagtaaagtaaaattattttatttaagatatgaaaataagaattgatggtaagcattaaatgtatcattccacttatacctaaattttaagaatagttgaagaatgcataatatacaatcattataagcactgacaatacaaagtaccacaattttcagaaatgaggaaagaatgagggaataagctcaaaaaactatttaatgattgcagttatcatatgggtggagtaatatggatattgttattctgagactattgtgtgtatcatgtgatataaagccaagcagtaattatgcaatattccaattctatcatcccctcacttcttgagaaccaggattacttgtgtgaaataaatgacatatagaagtaacctagaaaggtgaattacaataatcaaaatgaactcataactttaaaaaagtttgtgacatttataaaaattaaaattaatttcataattatatataatatatttaacattagtgtacgatcgttctgtccactgaaaagtcctagaaattaaagaaaccagcagcacacaaatattcatgttgtctacaaatatagacagttttaattcttccttttcaattcttatctcacattgccacacagggtaaggcctacattatcaatgttaaataaaagtgggaaagcaggcctcattgtcaatatctcaatcttagaatcatagaaagattttcgcaagttaccattaagtatgaggtttccctaaattttctgtgaggcaataatttttaacccatattttcacttagcaatatcactgtactttttgctttaaaagatgataaaattctcactactaaccttcttgtcatctcatttctccaaccctctatttttgttaaatatattattctttgaataatgccaaagtttatagcattaaattgtgtgccataacgctaatttttaagattattttgctttagttcaggtttaagttgactcattactaatcaccttgtatttattttgaattcagtaccctttgttttcaattcatatttgtctcatgattgccttgattttgtcattgatattttccaaaggagaccaatggatgttctattttttgagttattttgtatttgaaatgtatatatgttgcttttatacattaattgtgatattctttggtctggaaatgtgtcagtaaatgtttaacaactagctctctgaaggaacaaaaagaccagattttagcactggcagttttcctgagacaaatgatttcatcatggctgattccaagctatcaacatggtgccactgaaagtaaacggaaagagatgcttgggagcacactatcacgtaatattttgcagtatctccactgtatagacataatagacataagtaactgcaaaatcatgtataatcataaaatgtagtaaaataattaggaagtaatgagtcaagcatttattacttctgttttttaaaaataatgtatttcattacaagtttctataatttagttttaaataatggttctgtttaacttttgtctgatgatactcctaaaactttaacaagctgggtccaacaactttgtcataccttatttactttagaacgatgctgacaatgtgcttttatattcatgcattaaatgttgctgtagaaacttccgaagctaactttttgcaacatgagaactgaactgatgaactttgccccacttcgtactttaagcacatagaaattctggataaaatggcaaatattaaataaatcaaaataagacaagataaatctccatgtgtgagaaaggaaaaatgaaatcaatgccagagcaataatttgaaactgattcagtgacagctctcaggtgttagaggaggcatggattatagagctgggtgctgagagtctaaagtccattcagggagaagcagctgaaatggaaatggattagaaaatctctgtccgtcatctcagaaaaatagtgagtattaggtcttaggttttggatgacgggaaggaaaattactggcacaaaagaaaaactccagacccacaccactgatagacatttgaattcgctgaatagtacattaccaataaactcagaaactaaccaaaagctagtgtggaatattgaaatccctgagtttccactgggaactctctcatcataaacaatcatgaaaccatgtggtggcaactttttataaggcaagacggaataattaattccttctgaagatgaacaaggtatgaaaaagaagaaagcaataaggaaaagattgatgagatccaaagggccagatgacccaacaaaaagaaaaattaacaacccaagaactagaagtaatggaataatatggaaatattcaaataccaaagatgaataagagcactggatataattttaagataacagaccctattgaaaagaataggtgaattcaaaagggaaccaattagaatttctagaaacaaataataaatagttcactagacattaaaaaatgaataagtggattaaagaggagggtagatgcagctgaaaagaaaacatataaggtggaaaatggagaataaaaagtattttcaaaaccacatgggacatttataaaagattttccaacaaataccaaaataaccagtaccataaatcaccttctctgataacagtgtaattaaataagaaataaatgttcaagaactgaaaacaattcacataatttttataggtttaaataaaagtatcaaaaaaagaaaccagaatggaaattgtgaaatagttgaatttaaatgacaatgaaggtagcacagatgaaatctatacaaagtagctagagcagtgttggagggaagtgaagagctttgaagacaaatattagaaagataggcctgtgatcccacgctttgggaggccaaggtgggcagatcgcctgaggtcaggaattcaagaccagtctagtcaacatggtaaagccccatctccactaaaaacacaaaattagccaggcgtggtggtacatgcctataatcccagctactcaggggctgaagcaggagaatggcttgaacctgggaggcagaggttgcaggttgcagtgagctgagatcgtgccactgaactccagcctgggtgacagagcaagccactgtctcagagaaaaaaaaaaaaaaaaaaaaaaagaaagaaagaaaagaaaagaaagaaagataggtggaaaagtcatgagctaaatgttcagtgcaataaattataagagtacgttgaaactaaagaaaatacaaagttggaataatgaaaatcagagaagttaaagaaatagaaaaataaaacaagatgaacagaattaaaggctaaatctctaaatgatcaataaaacagaaaaaggtctatcaaaactgatgaaacaaacaaaattaagacactaataaacatgttaaaaaacaaaaagacatacatacatcgcagaaacttaaaaagaatattttgaataacttgaattcaataatcttgaaaagttatataaaatgaacaacttattttattttactttcttcataagaaaaagaatgtaaaactatctcatttattttttatagtgattacatattaaaatgtcaaaatggcaatatttaggacatactgggtaaaataaaatattaaagttaaattaacttgtttctttgaactttgtataacgtagctgctagaaaagtgtaaattacactgaacaacttaaattttcaatataattacaagaaatatgaatttcagttgattttagagatgagtctcctttaaataataacgaatctatagattatatgatctgttctagtcatagaaacaaatttgttaaaaaatgaggaaacacttcctaaaatctttttataagacagataacttcaaaacgaaaaattgacaagaaaaacacaagaaaacatattaaaataatgacagtaggagtaataataacttaaagtgatttagctccagacactttcagaagtgatttatacatttacatgttcctcataataaatctatgatttaggtaacatggttgtcctcatgttacagaagaggaaaccgtggcagaaacgtggtgactaatctcccctaagtcacacagatagtaccctgtgtacacactcaaaagtgaaccaaacagtcttgcttgggatcctctgctcttaatcattcacttcaaattttttaacaaaacattagcaaaccaaaggtaacgatgtatttttagcacaaaatgataatgtaaggttgagagagacattcagagtatttcttcttagtcaccaattcacattcctagcatatgcaatctccagtccattgttaggtgcccataagattttacaaattgacaaacatatcttctttctcccaaaactgttcaatctcagatttgttccttttccatccatttctgtctggctatataggcataatacttgatggtcacaccatccccttcccaccccccatcgtacttaaaaccattcaatgatttcccattgtttttaacataatgtgcaaatctctcatcacggcctccaagatttgttcacagctgacctctctagcttcttctagaatcatattctttctggctttctgtacttcagccacactggccatctagaacttgaccctgtgcatttgctcatgctgttctcttgcaaagaactccccactcctccctttttctagctgtcttccactcttgaaggtctcacctcaatatcacttctcaagggaactctccactgagcttcccacctcctaagactaggtcagtttccctcgtctaaattctcacagcactctatcccttttcttggtagcattatgcatacgtgtaaattcacatctatttgtgggatcatttcatttatttttctcttccccaactagaatgcaggagaacaaggcccatagcccacatactttctttctagcattgattaaacactagttaaacaccagtgtttaatgcaatactttcactttgttggaataatttaagaattattaagagaggagaagaaaggagtggtaagttatttgaaaaagatagctgcaattattattctccatgtatccatgccccttgcacctcctcccatcaagagataggatgtatttgccaacccccttgtgatgtcctttcctcaatggaatgcagcagaggcaataatggcgtagtggcattggtgctatttactcatctaggccagaagagatcctgtgaacttctgctgtcagtgttgaatgattatgaccaaggatagcctaatgggggatgcacaaccacagagagacgcccaagcctagaccatcctagactagtcagcctcctaccaaccttctggctgacctctgacacataagcaaagccagctgtatcaaccaatggagactggcctacaaaatcagaactgtcccactaatccctagactcaagagcaataatacatggagtatttttaagccaccaagttttggggtaaagaaaaaaggaagaaaacttaagagggaaaaatggagaaaaagatataaaggtgtgtgtgtgtgtggataaagattcaatgtttagctgcagaaaaaaatgagttcgcccaagaagttatgcaaagagaggtctaggttcaaattaaggctagacttaataaagagctgagtcttcaaaaaaaaaaaaaaagaaatggaatgaaatccttgttgtgcaccatccaatgttatgaataaaaaacaacaacatgggattttggagctagagttttaaatcccagtttactagtactaagtatctagataatgttcttatctaagtgtgtacaatgcagccaatagctactactctgcctcctgctttgggagggcatggtgatactgatgagactatagttctctcgctacaagacctgccagtaaattctccactcacaggtgaattctggactcacttaccgctcagacttgggctgacgtttctcaattagggccccagatgtccctgtgcccgtgggatctcagattatccctagactgtaccacagatatccactgacatgaattatcacagtctttctaaccagctgaggttggagcctgaccttgaatttattctctctggacaggactctcactcccatctgcctcttccaagcagtccttatatgaatgagaccttgagcctcattgcacgtgaactgccatctttattctcacttcaatctatttagccttccttgagctagataccagcaccatcttacctatgaacccagactctactcaaatatgtcactcacgattcggctggatgctctgaacaacaaagttagaccccactgatgttcattaccctgaaatggatgtgatgattggggttgtctcctgtcaccctttggagtccagccctacatcaagtctgttcccgtaaccccacctctgacaatcactaatagacctttgagtctctttctgtagtcgagaggtcctagtacatctcatgagaaggtccccgagggttaggccacggacattgtttaaaaatatataaattataaagtactctacaaggacttagtgttaccatcataattatctcatgatgatccagttcttgctgccagagatgctgctatgtagaggaatgatttgagatggagactggacttctaagtgccttccatgtttaatcatccgaagtcctgcagatgcactgaattccattttaaaattaacagaattaggcaaattaggcaaaatcctattttctacatgaatttcaagtattgtttgatttaaacctttctcttttcaccacactcttttaatctaagtggtagcagtaaaaagatgacccaactaaagttttgccaggtgggtaggtctagactcatcaaaataaaaatgagcaaacaaaaacgaggacttgctttgtgtcagacaggtttctaagtgcttgatgctactcatttattctcacgacaaatgtatgagataagggctatgattatccccatttcacagatgagtaaggcaaggcatgaagaggttaagtagcttacccaaggtcacagggccagcaaataggagggcaggaagtaagccctgaaaacgtaatccagggatctaggctctaaaaccctacatcttccatgtggatgcacaagtcgctgcttccccagtgcccccacctggtattacagagataaaatacagcttggtttccaggccgactctccctccaagtcagaaactcccatctctggtgcacatgaaccgggattttccagttgtgcttggcgctggctccctggagagaatgtagcaaattgggaaggctagaactatctcctgcccagtcctgctaattaaactcctccaactgacactttttggctggttccaaaaggatattatttttagcacgtgagggttaaaggggaagggaagtgtgctagattcaggttgttagagagggggagaaagagaaaggagctcggagggatgcattatgattacgactcgttttaataataagatggagaaaattgggagtctgggccggtctcaaggccttaaggaaggctcctaaactctgtcaacctccttaatggttctgccacatttaaatgggtggaatatttctctactcacacagtcccaatgggcctgcaattgcagattttagaagtatccagtttattttattattattattattattattattactatttcctggaatgaaaagaagagtaatgctttgcaggctggggtgaaaggagcattccatcttccccacccctttttcttgcaaggctctttgacagccacaccctggcctaccctaagaggtaacaaatgatgtactaacatgaccctgattaggaagctgggaggttaatctgcagggctccttctgataaagaccaggccagaccatgcacagctcggccgattgataaactctgggcctgcataaccacaggagcccatctgaggtgtagagtgtgcagttctgcctcccaggactccatctatctacgtcagtttcacacactcacccactgcctccttccttctcccctccctctctgcttctgttccagtgattaaagacgcaagatccctagctatttacccgcagttctgtaagctgtcgaaacccaggggacacagccctgttaagctgaagcatgaaaccttgcacctctgtgatacaaaccatgaaatccttaaaactcaattcacaggaaaaagaacttttctcttggtcccgctcttcatgtgattaatagatgtcattgtttagtctgacagcaaaggctccattgtgtgacaagctaacagttttgctcctggacagagcaaagagagaaaatgcccatgacactgggaagatcatttttttcaggactcaatgcaatgccatttttttaaagagcacactgatggaaatttcagcatatgcaataaacatatactgtagaactgaattaatctgcttgtactgaagggcaactagtgtgcattgtaagggtgactggtaattaagtgtactaattgagaggaggtaagagccagacctggatttgaatctctgctcacccacttactgcctaaatgaccttaggcaagtggtgtctccctttaagacatagatccatccttgtaaaacgagattaataacagttacgtcataaagttgtatccaggatgccatgagatgattctgttaatgctctcagcacagtgcctggtgcagaatgagtccttccctaatattagtggtcattattaggtcagccatgaacataaagaacagggagagacctggggcaagaccaaatccacagcatcatctttggcatgaagtaggttttacttttcaagcctcaataaactggctgcttctaataatcaatgggtacagaacacatagcagttgtcatcagtccagagcaattgctcattgtgataccaaactcctccttcaattagcaactgtttatttaaaatatgctcccccaaaaaagtaaagtctctcattttggagacacattctagagactgtaataacttggattttaatactgggagttgattaacatgtgatacattttacagtaaactaaataagggttttactcatctatgcctcctaagagaatgggaaaaaatgctttgacttgaacattttgaatgatgctaaatcaaacatatagtgatccttaatcttggctaactttgcccacccacccattctcctggaacatttgacaatatttggagacatttttggttatcacaacgagggtgaggggagttgccactggtatctagtgggcagaggccagggactctgctaaacatcctataaatgcgaaggatggcccccaccacaaagcatcatccaattctaaatgacactactgcttagggtgaaaaaccctggcctaatcaaacctgtagggtggtgggagaaaactagatattgtaattgaatatttaatgaaatcttaatgtgtgagggaatttgcctagaatttaaattactgccttgaattgaaacgaatttcacctaataactcatttgcgaattatttgtaaacactgtagtttctgcttttatcttttgtatttaaaaaaagtttgccaattatgaaatactgtgatcttccagattgtcattgtttcaaaagctgctcaaggtggttcttttaatttagtcttttgcaaaagccaagagagtcagaagctgagctaatgctgtctccatcattcatgatgaaaattgtccccgcaagcactttcccctgttccccccaccaaaaagaaaagaaactcattgcaaagatttcacttaccttaccttcaatgtaaagattttcctcctctaaattctccatgagcatggttcctaatccgaggataggatttccccaatggctgagatggtggaaatcaaaacattcgaaaatataaggaaccagatataggtcccactcactgtttagttttctttgcctttcatgcccacagaatacagcattgcccatctgagaaagtcattagtgagagaagagcttttataagctcttccttgaaaatggggcatgcttgctgtttttggaaaatatcagcctggaagagataaagttccgtagagggcaaagctatcaaagccaaaatcacacgattctttgatttcagaggcccttgcttagaatttggcactgccccacctccatttccccctctattcccatggatcaaccaaagccataacacagccctgggagcccagagaggactatagtaaaagtagtatttattaaatgtgagttatgagccaggaactgtgcaaggtgctttagagacattagttcctccagaggaatttcagaagccacaactaggttagtgtaaaaacagtttttttaagggtttgagtagattcttgtttaaactaacacaagcctaaatccagattaataaatatacttttaaaaaatgtcaacacagccatggagttaccgtcttactgacacactcttcattgcctctttccttcttcacaaggctgtgatttccttggagcatggcctcttaaaggcaagtgatttatctgcatctacttatccctatacctagaggaatacctggtttagagtaggtcctcattggttcctgctgaattattgtattttaatcccaacataagtgaatgttttgcatgctccctggaacataatagaaactcttaatatataatatactaaattgaatttatccacaatacaacgagtctaaaaacagctatactatagagtgggtgccaaaatacaagtggactaaccttaaggacagtgccttagggtggtacttgtgaatataaaagactcacttatgtttactagcatggcactgggacagggaagagcctcttagagtgcagaagctatatatttgcacagaaatccagccaaggtttgcaagcagtggtgtctctactctgagaagcagtgtgggctgcagtatgatggctacttggagccctgcactccacctgacctgtgtgtgacccttaaacctgacacctcagtactcagctgagaggagacctgggggatgtggacaagcagcacccagcacaaccaggtatgtgtgatgggaggcatggctcagctgaatggatgacccagcatcaggctcaatcctgctgaagaggcagagaagatagtgttaggactattgagaatgaacatttcaaaagagagcaagagtgtatgctctctgcaaatccaaagagctttctgccattgatgaacgtagtaggcagcagtaatggatagtactagaaagcagtagagccttctcaagcagtagatgtgaggtaaacagtctctcgctgagtggtggatctccagagaccacattactaaatcaggagagacagcactaacaacatttagatatttgaaaaatatcctcagctttaaaataaggataaaagttaatacataacttcccaacttcctatgagtaactctgtaacatctggacatggcttccactgagtccgtaacagagacttcagttgagtgttcaaaggtgtaccacacattggccttcacttcctaccttctattctttttttcatttttggtgagcatttatcatgctattgtgttatttactagggcaagacaccacccctaccttggaggaatgtttcgggaagatacatattacttaacaggatagcatgataatgacaataacagtaacaataacaataacagctaacatttattgagtccctatgatatgccaggcactctgacaggtgtttagaggttggaataaccctatgaggttgggctcctgggatcaaaatccaatgcctacttgatggatgtttctttccaaggtcagaggccatacctccttacccttatgctgtcagggaactggaagagagacttagcaccaacaacatagcaagcatgtcactaagtgcttttgcctatgcaacctgcttcaaataagctgaatcataaagatttctaagacagcaagaaaatatccatccaaacatcataattagaacaacaaatacttagttcatggtgatctactcatttgataaatatgtactgagcatatgctatatgacagatactgttccagcctcagacctgtgcaatgaccaaggccaagaagtccctgccctcagggaaatcacatcctagtggaaaaaataaactatgacaggaaaataaaaagaaagaatacataaatgagattacttctgataagttctgggaaaaaaaattaaacgcttccaagtgatagaaagttcttagttagggtagcagagggtggggcagagccaactgagcagggacaatctgagaaggctccacagggagacatattcaactggaggagccagccttgctgagattagatggaagaccattctaggaagaggaaagaggaatggataaacagagaggcccagaggcagaaaaacaaagaaagccagtgtggctcaagtgcaataaggggacagatgaagacagagaggtcgacaggggactgatcacacagggtctggtgggccatgctaaggtgtccgaaaatgccactcacattctatgtaggagtgtgacatggctctatttatgtttagaagagatcacccatggtgccatgtggctgctgtcctagacagccaaatacaagtgactatttgccattctaaggaccttcctttattcattgaattcagaggcactaactgtggccagggcatgctgccaaactctgaggctgccatggtaaggtggacagagtccctgccctcgagtagcttacagactcctggggtttacagttccacacgtggaaaattaatttctgggttcctccactgggaaggttcaggatattcaagacatagccagggctctaagcccaggtacagagtgacagggctttcgggaagggatgacttcccaactgagattagatggtcataaggagtcacacaggggaacagagggagtcagggcaaaaggtgtttatggacaaggaaatgtcagtgggaacagggaccacagtccagcagggcaggtgtggagcttaggagtcaggaagaggccagagaggggactggcccctacctggagagggctgtgagccagaggtggggtgtaagtacagagtgcagcagtctgcaaagcagggcctcagcaaatcctcatgcaacaggactaaaggcatcttccaggagagaatccagacacaggcgaggataacatcaaaggatttctgtggctggctggttgctttagcattcaaggtgttcttcccccaaccacagctttcatccaggccctctggctccctggctactgtggataagccactttctgcttctcaggaacttgaaggcagttacttcctccaaactgaattttggtggctttatgtcaagtgcccagatggagaaagagaagctgtgattgctgctgctgctcccaaagccgcaagggagctgtttgcacaacataatggctggtgccccatcagcccttctcctatagagcagcacccagcacaaccagatatgtgtgatgggtggcgtggctcaactgaatgcatgacccagcagcaggctcaatcctactgaataggcagaggagatagagctaggacgattgagaatgaacatttcaaaagacagcaagagcatatgctctctgcaaatccatacagctttctgccattgatgaaagtagtagacaggctattaagaacagcttcagagccattcagcccaagttcaaatcctgactctgccacttcctagttctatgatactgagcaagttgcttaaccattctgtccctcagttctgtcatctaaattgagccaaaaatggtatttagtatgaagctgttatgaggacccaggaagttaataaatataaggcccttcaaccagtccacaacatatgataaatattcattaaatgttagctgtcattattccctgtttgccaagttctggagattgagaaatggacagagagagacatgtatcatttattgatgacctactatgtgtcaggtattttgtatatattagttgtaaggttatagaaaacatgcctgaaaattttttactatctcataacaaggtggagtgtatttctcctaaatgtaatagagtgacgaaaattccatactatagatatataagtaatgatttctacataaagatgaggctgcaagtaattatgattggggagaggggtgaagtgtggaagggaacaaggattgcagtggaaagaaattagcggacaatttgactgttgttcttctttagtcatttcttagaattcatgatatttacaaagcacatagcagactacacttggtaatggaatttccctatcttcatttacttgttcccttgttaatgtccatcactgcaagaggcattaagtatggtgctaacatgccagtaaccccacctaagcagagaaacttcagggagccatgtcatgttaccctaccccatcctgcccagtgaaaccagcagggtagccaagacttgctgcttgctcaggacctctgaggaactaggtgcaaaaacccaaatggaaagagacagactcataggattcctctttgagtggcaaattggatgaccaacagagaatcaggagcagaggtaaaagtagaagcatgtgatagtcaaagccatgaatgaggagaaatgatagagtggtgagtaaagccaaccaggaggtgagtgaaaaccaggcagacacagacgtgagcagattttagaggcagtcctgcagtgaggattaggagtctcttgctactgcagccagcaatacctgatttcacaaagcccttgtaagacaggaacccatggtccctgcccttcctgaggcctggccattaactgttccctagggtttttgagacccagccataccaagatgcctgattcagacatccccatttgtaaccttagagcaatagttctcagccaggggtgattttgttccaagggtatgtttggccatgtgtggagacagttttggctaccataactggagatggaggcatactaatagcatctagtgggtagagaccagggatgatgctaaagaacctacaatgaacagagtggacccccatgacaaagatctgcccatcccaaatgtcaacagtggtgagattgagaaaccctatcttaaagagtcaactccacatgacttgaaacaaccgcaggcagctctctgcctctggaaaccgaaagaattcaagaaatgcaatggtttttcacttctgccatattattaattcttgagggcattttggggaatgatagatttgcatcctccacagttcattgtttgggttctgctgcaaagtagtcatttaataatacaatgaatttgccttgtaattgaagatgggtttcaacctctgatttaaatctcatagacaacggcacccttggaaagcgctcaaatcacacataacacttcgtatatgcaacatacatggtttacatatagatacagggcttgttttgtgttgattcttatgtttgaaaatttgaagtttaatatgttggttgcacatcaacatattgggaagtttcacgtgacaagctgtactaggaaacttgggactctcagatgcgaaaaaaaatttgtgatattgagatgtctgtgcaataaagactccaaaaggaaaaaaggcagatgggaatcacagatttaaagaaataacatagagagacatcattctataagaatttatctcagagtaggactgcgggtgataaatctgaaggagctgtcttaaactaaaatataaagatcaggaaactgaaaagagcaaaacttttaaaccaaataatatcaatgaaagttgtaacataattatctttaactgtcatttatttattacccataagatttcaggatccagattaagtgttgtgcatgtcttatctcatttaatactaggaaaacttggggctcttttttcatatctaagatgtcccataaccagttagttgtatagtggggtatggagcctgcattttcagtccaaaatatttttattttctagggtaaagacaggatttttaccctaaatctaagccttcttctgctgagaaaacttgatgggaaattcacctatctcaatgtgtttgctaggacatctctataaggaggagaaacatggatcccttttgccactgctaaatgatcaggaagacatgaagagcattctccaatattcttaccactcttggctatggagcactctctggcataaatgtgtttggctctgttcttcagctacaaaatattcatatccaagctactgtcatagtgatgtcagtttagtgaatgacatgtggaactagattaaagtaggggtagctaaatgtggagaaaacaagtaagatacagaatcaagaaacacacctatttcccaaggtaatacttcaccaaaactagccctaaagaactttctatttctagagattcctaccctttgtaagaaatagccatgaattcttctcagcctgtaaggggaagacacattgttggaaaggtagtttaccctttgattgtaataagggcttgaattttacctgtgcttttccagatatgacctccagccccaagttgtcaagctgactgctcctagcttcctttgagttgatggtcatgcctcatgattccacattcagaaattcaagccttaggtcaaattccatacttctgtgcaaatctatagaaaaactaccttctaaataacctgggattcatcttttaactctcaaatgactgatacttcctgccatacatagaccaaaaagagtgttttctataatttcctgaaatcttatgtagttagaatgtttattatatcttattctactctattgttaaaatatagtgtgtaatatatacgctgtaatatattgaaatatgtttataatacattgtattattaatgttatagtataaaatgatgatttttttaaagattgctaggctttaggaaaaggcctggcacgctatcgtttgcaggctaaagctatcccagcacttgtttttataaataaagttttattggaacacagccatattcattcatttatataccatctgtggctgattttgcactacaatagcagagttgagtagctgtagcagagaccatatggtccattaagcctaaaatatttacaatctagtcttttacagaaaagatttgccaaaccctaccttagaatagcataagaactgctattgggactcagtttcctcattaaatgaaaggtttcgctgagagatggctaaaattaagaatttttttccattttctcattatttgatcaaatccaaatccaaatctggggcctctcctgcatttagtattccagtaaaacgtgaaggccatgtccccaaatatcctaatatcactaatgatgctttacacatgccttaacttctctaagaattttgcaaaagaaatgatgcctgttaggttataactgttctatgctacctacatatatgcatctgtcatgacacttaactctatacctcaagccctttgtccacctctactgcccttactcatctcatgcctacctcttcttacccacgctggcattgcagccataaatcctaacactctggaaagagccagatgtttctattttatagcatgttaacctcatcagtaagctatgtttgataagatgttgtgcagcataagagcaaacctggtgtgtgcatcatgaatgggtgggcccactccatgcctacaccttggtgccaccctcagtcttctccatgggcagtgccactagccttccagctcttctctgctttggtggcttgtgcttctggtcttcaccagccatgacttcaatgtgtggcagcttgcaatgtgtgcatttggtatttggactgtcccctctgacctctggcttaaccttgatgatctgtgcacctggactgtccctagagcatggcctcatccgaccaagcctgtctccactataactctgtctccagttggcatgaggtaagcagtgtggaatcagttagaggccactggaagttgaatgcagctaagcagtggcaaggcccatatgaaatggaaaggaaaggagctaatagggcagtagcttgacttagagaattgaaaggtgcaattgtttaagtgaaccaaatatgttctgctgaactctgtgcctctctcctggcttgagaaagacaagggccatacgtatttgaaagacgcatttggcatcatctgtgtatttggggaaggaatggtgacgagaggttggggtggaattgtgagaggcctaaaatgccaaagacattcctgaaatttttggctaacttgcataagaagcattggatcttcaaaattttatgttaaaacaaaagcccacccgcttacattaatgctttactgcagaactcacacagcctgatggtgaggcagataaacttggggccagactgcctagtttcaaattcggggtccatctttcaccaggtatagaaattggagtttacttgacttctctgtgcctcagtttcctcatttgtaaagcagaaataatagtagtgagcaccacatttggtgatcaggtagagtactaggtcttatgcagtatgtgccacagttgtccacatcattgacttttcacaatgagtagtaatacagtaggaactagcagtatccctgttttacagatgtggacacagaggctcagaacatttaagtaacttgtcaaagaacaaaaagtgaggaaacagcaggatctagaagcaaactcagatctgttcaactcccaggttaggcttttacatgttctgctctactgacttatttattgatttttaaaaatgtttgtagtaaaagtgattctttctcttaactttttagttttggaaggtttgtttctagaaatcactatccatggcccaagacatcaatgcagatggtggaggcaagggctgaggctggtttgtattcagtttacatccttttcctgaaaaaatcaccacagataacaaataagcaagtctgggaaattgtggagatctcttttttgatttttttgatttttttatttttaatgtagcgcatatcattatgtatttttgctaatctagagtatctaccctgttcatttgttgcttctcctcttttatcttctcagtcctttcccttagtaatttctgacaatgccccattgcagaatactagctattgttttggatgtttcatgaagaataaaatctaaacaattcttgttaaaaggaaaggctaacacacacatgcacacatacacacacacattatataacactacatatatatacacatatgtataaaacactatgtatatgtatgtatttgtatatgtgcatatatatacaataatatagtatatgtatatgcatatgtgtgtataattatgtaattggagaaatcttatgctttagtctgaaagttgacatggagcatgtagttttttgtatccatactcaccaaaagctggtgcccattagaaagattttgctattagatgatattgagaggaaacagttaaattgttaatttacacatacatagattccattttggtgctgataaagaagaatgagggcataagttacaaccttggtagactcatttgagctgattcaaaggggcccaaggctagaaaggagagcaaagagaaaggggcaggaggtgaaatgagaacatttctgcttgagttcctctggaagaacttaattagagtccttacttggtgtttgactctgtgctaagtgctttacattgattaacatttcacatgaaccctttgagctaggtattgccattattcctattttcaagataaaaatctgaggtatgagagatgccataccttgcccacagccatgctgctcatacttgaagaagctgaagcaatctgattccaagctcacttgattaagctctaaagccatcctgaggttggcacctcctagaacacagattctctgaagtacaaatgtacacttgttggagtctcagcctaatgaggattagggctggactaaatgtgtgtgtaagtacttcaggaaccacatgggagtgtgtgcattttggggagccagccatagcactaatgtaagtatagtgctgcaccctgatccaaacaataaagagagagagagaagcaaagagggagggagggagggagggagggagggagggagggaggaaggaaggaaggaaggaaggaaggaaggaaggaaggaaggaaggaaagaaggaaggaaagaaggaaagaaggaaggaagaaaggaaggaaggaaggagaagcaaggaaaggaaggagggagagagggagtcaggcagggagagagagagggaagagataaaacaccagcttgtgtcagatgtcacttgcagataagttgagttttaaggacacctgcagctgcaggtaaaagaaaacccaaaggagctcaataaataatccagagatagagagaccctgtatttagttaattcaaatgctcaatcctcaacagagacccaaattctttccatttctctgctctgccatcttaaattatgaactttgcctttaaatgatgtccctcagtgcaaagtagtttgagaattcacatccagatgtaaacacattcagagaaagaagaccgtctattttgatgtgttcttcttaagggtaagaaaacctttctagaacccccatcagttcttgcttgtatcaacaaaaacagatcacagatctacttctagaccagtctctggcaaggggaagggacccccgttgcatatattggcccttagagatagatgggatcctggttaatcatcatgatccctctgcagcagttgatcataacacatttgtgcccatgccaaagaggccatctccgctaaatatatgaacccactgactgcattaaacctgagaaaagggatctaatgtccaactacccaagagcagaggtcccatgagaaagggtgtgtagtttaggaaagcacagctttgtgtgctgtttgtcagtttccctcaatacctagggaattgcacatttatttgtatattggaattggagaggtatcaatagaggcaaagcctctgccctaaagaactttaaattctaatggaggtggggaagcagagacaaaaaaaatagaacaaccttataatttgtaaggtggccaacagtactataaagataaaataaagggtgacaaggaaatagaatataacaagagatgtacatccttccttccaactggaaagatctcttcatcttcccaggctacttgcccaggtaagttaactcctgttcttcttccaggtgtaggtttatgcatcaatccttcatggtctctgtcttctggagctctcccttctcttaaatgaatttctccttcttatcaccagaattgcaatttcctaaatgttcatgtgattgtttagtagatcttctcgagatcataaaaaccttaagaaccaggaactcagtctatttgctcaagattctgtctccagcaatgagcttattgtttagcacatagtaggcacccaagacattatttttgagtgacggaatgagaaaccaaaaaaaaacttaatagtggcttttggtggggccacagaaaagaaacatctttccttggggccactggttcctacctagtatgacacattgcatctcaggctgacgcaattacagttttcctgctctggacaagttctccagattcacatgccttccctgccaataaaggattttaaaatatgtaagctacatattattcttatatcctgtccttcattgggtaacagaagtgtttttcttttgtgcagcttgtaccccactgagacagcacaggaagcacaaaattctatctttccctggggacatgtttgaaaaatactctagagaatagaattgacagccaagactttgtaacacccttgaccaagaaaactatatcccacacatggcttctttgtgtatagcaagccagcagaaaataatattgtatatgtgggaaaatgaacatattgattgtgtttgctgctcccagatacattttgtttcaggcataaaagacagaaaggaagttatggttcactgagtgtctatgttgtgcttgacacttttaatgaaaatactaatgatagaaaataagattgagtgcttgcctgcaagatctcattcaatttttataatgctttgaggtctatcctattatgattcccattttacagatgagaaaacagaggctcagggatgggaagtcacttgcctgtgatcacatgacagatgagcaatcaggatgggatttaagccaggtcatactgtttccaaaggatttggtaaatctccaaacttactgccttagtttgggttctccaggaaacagactcagaaagagcttgagtgtaggtagtttttgtggggggtgatctcaggaggcaggagtgaaggagctgggagagcaaggcaagaaggtaggaaacaccagcataagggtgcttgctgtggtttcaggtcttaactctgcaggatctcttagagaccagggcagttactaccaccagcgtcagtccctgcctggttgaatgtgctcgtaagggtgttaattctcttccactttcaggatgtgtctgaagagggctgagtagactccagagaatctgaaaaagactttgagtcaaaaagcagaaagaagcttagcaaatgcatgaaataggtgccgtcagcatgagtctcatgaaccggactccacagctgcagctgagtgtgtaggtggcctgagggatgcggtgccggccactgacaccaacaactctgttacacttattctagctcaagttctttttcctccttcttcaccatgaccttgtgagttaggagatcagttttcaactttctagctggaaaggttgaggctgtgaattgtcaatgacttgccagaaggcacacagtaaacagtgcccttgggacctctgtttagaggaagagcttcacatttagcttgctttctattgtgactcactctgttcaactaagttatgaacaagcctcgatgcacaaggatgaaagaaatcagatttgagaaagcccagtcttcacccatggacagctgagaaaggcatgagacaggaatattataattcatctataagaaagtgctcatctaaagaagaaaatgctagccagacttcctctgagacacagccaggtaagcaggaaaacgtcattgtctttagaaacagaggagagcttacagtctcttaatatttttaataacctttatatttatacatttatatattgtaaacttatatttataagttataaattaatatttgttatgaatttatatctatatattatacatttataaatatatattttttgatttacattcatttatattatcttcactacagtaactacattcattaaatataaactttgacatcctatcagccctcagaggtctgcttggagtattggagaagacactaggtattttgtctgctttttaatcagtgaatggtctccaaattaatatctatgtatatgtatatatttatattaaataagagtcatttgggggatgggcatcctatgcataatatttgaggatcttcatctctttttccttcaaagaatcttcagcaaatgtgcaaaaacagattgagcaacccatgatcctgtaggtttccagttttgtcttcactctctgaacagggaaggaaaagacttgaggcaagtctctagatttcaatcatccaggaagcaattctgggtgataataagagagactggcaaaaaagggggaaagaggggaaattactggcttggtcaaagcttgcaaaatggcaccagtgattaaaacatcttatgctgtcctcgggctgcagaagctatcactgacaaaagagctcatacacacacacacaaaaggaaagaaattagccattaagaaatatttcagcataatgcaattattacagctgtataattgaatggggaaaccattgatctgtagtagaaaggaaattgctcttctcattgtgttcctatgaatatgtgaacattaatctccatctataatcaacgttcatttcaaatctgattgcatgctactaaacacccgtagctatgctaacattatgttaatatggttcaacatcatagctcccagcttcacagcacaaatatttttctttggcaatcaatagtaatttcagctgagtggatggaagtcacgttttaatggtaatctttcctccaagcctccaagtggaaactcagttggtgtcttaacatggctgcagcatgttgcatataatcagataaattaacctgaaaagaaatagagagagaggaaggaagggaggggacatggatcagaaataaggaggaagcttagcaaaactctagctaatagatgaaagtgtacattaggtagaaaaagagtgaggatgaatgggtagatgggacagagtgaatgtgtgtcggaggggcatgcaggaagggttgttaagaaatgagactgtgttccttctggctataagtcaatgggatgggatggagcagccaggatcctgggcaatttggattttgccaaagcaaccaagatacatgaggaaggaataggaaacttaacaaacatgggtggatggcataccgagtcatctctgcttggaagagttcactcagatatctcctccttctcatatccacacgttcatttacagcaaacaatagaaaatatagaaaattttatagatttctatatctataaaacatacagataattttgaaagtgaaaaaaatttataagggagaatcttttatttttaagcatggctactgctggacaccaagaatatgaagatgaacgaatgtcatctctgatcactaagagttgatgacccagagtgggagaagaaagataaacaactcacagtatcaacccacatctcctgggatcctcctccttcccctggccataataatcctctcccttcatatttttttaaaagaagagagagaagagggagaagcattttggttacattcattcctcaagcacttttttcagccccagaaacctaaatgatggaaattctcagacacaatcattggctccattcccacatccaaggacaatgccctccacaacccccgtttttttacataccttgtctaagactgaaatcagaggctccttctgtgataagaatcaaagttacaacctttatgtatgcaggttgtttataataaggcaaaggaaaataaaacctaagtattctcagcctcttcacctgctctttcaaagaaatctggagttgtcacttcccttcacagctcccccagcccctggcgctctccttcctggctcctgttttgaagatcaggggaagagaacattctcctaaggacagcagggtatccattgatataagaagggaaatccagaggtgaggggacagtgaaccaatgatacagcacaaggaggaccctgcaggacaaaagaccattagtattaagtgtttccttgtttgaggagttcagaaagaggagaaaaatcctgaaagagaaactgccaaggatatagaaaatactgaaaatgatggttatagggaaacagatttttttgtttgttttttgacggagtcttgctgtcgcccaggctggagcacagtggcaggatctcagcacatggcagcctccacctctcaggtacaagcaattctcctgcctcagcctcctgaatagctgggattacaggtgcctgccaccatgcccagctaattcttttgtattgttggccaggctggtcttgaactcctgacttcaagtgatccgcctgcttcggcctcccaaagtgctgggattactggcacaagccactgcacccagctaggtaacagaattttaaaagctttttctgtatattttgcagcttgtcccactctgtctttctctaaaaagacctcagtaagaaaattaatatccttttcctatttgttttgctctttataatcccgaagtgaataaagatttccattgcttttccctgtttattttttataatttcaaaatgccttgtgtaggatgacagtgattatgattattatcaaatagaatttacgtaacaatatcaggaactattcagtttcctctctcaaacccatccctctctttttatccctaaaactcttgcccacctttaatcttctgagctctccttgaattattgcacctgcctcctcctgtcctcactaaactcagtgttactcccttctcatctgtcacctgcaaaatagccaataaagctagcacaattgggcacaatttttaaggcatttgaaaattaaggatccagagcatgaaaacgggactatattttttcagccatgtttaaagtcatgcaatacttaatgaagtactacttgatgaaattttactaaacttattgttaaatgtgtagaagcttattttgagttttattgcttattagcaaagccagaaaagaaaaaaaatcactggggaaatattcaatcttccaaccatgagaaaaaacagctaaaataagacactgaaaacaatatggtgacaaataaaaatgcattcctttgttagcagattctgtctgaagatacagagaaaaaccttgctgaagatttgatgagtcaactgctaaaagaaattatttggtgtgtgaggtttgctatccagttgggtgcaagtatggatgcttctaacatttctttccttatggtatttgccacttgaaatgcagaatagttttttattttatactatagagtacatgtaatggggaagaaatattttagcaataaataacttcattatgaaagcaatattttatcaaataactggaagtggatctatcaatacagtggctgactgactggaatttactttttaaaaatgtccaagtcagattacaaagatcgctttggacataaaattcaaattgcattatcatgtcgatagacaaaaaaaattttcgaagctataaatgcacaaaaataattatatgttgtcatcaacaggcttaattttataagagaagatctttaaaatgtaagagaatatttacctttataaggaggtagagcgacattaaaattatttgtttaatgtaaacaagaatttaaaagagctgccagatttgaagttatctatttttcttttataaaatgacaagtatggcctggcgcagtggctcacgcctgtaatcccagcactttgggaggctgaggcgggcgaatcacgaggtcaggagttcgagaccagcctggccaacatggtgaaaccccgtctctactgaaaatacaaaaaattagctgggcatggtggtgggcacctgtaatcccagctattcaggaggctgaggcaggagaatcatttgaacacgggaggcaaaggtttcagtgagccaagatcactctactgcactccagcctgggagacagtgcaagactctgtctcaaaaaaaaaatgacaagtattccaagtttattgaaattactttctgccatgggagtgtctttcagtataatgtcatctggcagataattaaatggtaatagtagcaatgatgctaataatagtaaataataataaatataatctctcacttcaagattaaggtgacattttaaaaatgtggaacaaatatctgctatgtaaatggagcaggctatggagagtgtttcaaaattgggtatttaaaaacattcctttgttataagattttattgccaaaaacaatacaaacgcattagttacaagaactttcatatatacatcccttaaaatatataaacagcattgtttaatctgcataaaattctctaaacaaaacattatcatagaacttgaagtttctgcattaacatatggggaaatactttcctattctttataaaaccactaattggcattattgaagatagatattttctagattgcaataaaaactgttgcacaagagatgcataaaaggaaatggaaaaatgatgatgatgaggtaagcagagcctgggtgcccttcttttgcgttttggtctgtgtgccaattccactgatctattgctttgtaacaaagcacgcctgaactttatcattttctcacacagttacggtgcttggcctcaacttagtagtttttgctttgggtctctggtgcagtcacaatgaatggggctggaattatctgaaaggcttcttaactgtctgatgccttgtctgaggggactgaagtgactgaaatgtctgggtgctcgtggggcatctttctctctcagcagcctttccctgtggctagcttggctcccctaaagcatggccagtccagcatagtcagacttctcccatgatggttgcttttccctagagtgagagttccaatggacccagatgagtctctgaagtctctctctctctctctttctttctctttctttctttccttctctctctttctttctttccttctctctctctctttctttccttctctctttttctctctttctttctttctttccttctctctctctctttctctctttctttctttttctttctttctttttgacagagtctcactctgtccccaatggcgtgatctcggctcactgtaacctctgcctcctgggttcaggcaattctcccgcctcagcctctcaggtagctggaactaaaggtgcacaccaccatgcccagctaatttttgtatttttagtagagacagggtttcaccaatttggccaggatggtcttgatctcctgacctcatgatccacccgcttcggcctcccaaagtgctgggattatagccgtgagccaccacgcctggcctgaagtttcttataacatagatttgggagccccagaaagttaactttaccattctattggtcaagatctctaggaccagtccagatataagagaaagggaattaaactcaacttctcaatgcaaggagcatcaacagtacacagaaagaactgtacacagaaggaactgaagacagttatcaacttctgtatgaattggctaaaataccatatctaatagcacctgctactgttctagcatataatcagtgcttcgataatgtaaagaacatgcagtcaagtactctttaaaactcaagcacagcttgtgtggttatgatgactgattccttttcctgtttgctttaagatgcacagcctgacaggatttttattttctgtttggggaacagaatactaacaggtcatgtttattgagcatttctgacatgctgagctcttttcacaaatgattgaatttgaacccctccacaaacctttcaggtagataatctgtgtccttgaattctgcaaataagaagagtaaggcttggagaattttgtgacttttcctggatttcatagcatataagtagcaaatgaatgagaataacccaatttagctaatatcagtgactgagctctaaactgctatgtactagaaaaaaatctgcaaatataaatatattaaattatattttattatatattttatgaattataatttttaatttttactaattttgtattatttttatcctagtttattaaaatattccacataataaattatggtatattctttctatggaatacactgtaactatcacaaagaatgaggtaggtgcctatttatattttgaaaacaaagttacagatatatagatacatacacacagataaaatacacacacactaacatatatacagagaaagagaaaatttccacaataagatacatcagaaactgttacatgtagttaacactggaaaattggatttgaattttttgacagaactccattttttttttttactttattatttagcgtcatagcagatgctgtcccctccctgcccatattccctcagcccacccctaaggttctctacagccttgtctacatttcctatatacaatataggactttatatacatgaatgtggcttctgccctcaagccctgcataactttagtctctttctctctctctctctccctcgctcgcttgatctctgtgtctccctaccccctattatctctagatagatagatagatagatagatagatagatagatagatagatatagagatagatgatagatagatagatagatagatagatagatagatagatagatagatagatttatcttgctgtgcaggcttggggcagatcagcagtgcttggaaacaaaccttaaccaatgagggacagccgttatggatacattctctgacctctcagtgtgtcctcttcccagcgtgtcctcttcacagtctctcaggggccccagtgggatacagcaccggttgcccccagaagtgtccctctccttgtgcaccggttgctatttatgctatttatgttccctgcctcacttcccattccctcaccaagtgccctgggattacctcccagataaattgttacatcaggtcccttatcccagtatctgcttttgggagaacccaaaactaagacaaacactatttgaatttttgcaatatgctcacataattttcacacaaataggcaagcaacatcaactccagtttaaatgaataggatcattgaaaagtacagtatttaatgcagcgtggattgccctttccctgatgcacattctgggtctgttgccgtggctctgagtagcctttcagctcctaccaatagagaagaagagattttgagggccacaactgacgtagaggaaaagtggtctctgggcaggggggtctttccaataaggcttggaaaacagggtttcacccacacacaccatgttgtaaaaaggtgccatgttttgcttctctgtttcccaaccctaccccatccccagccatctttcgttgaacactgcttcatgctcatcactatgccgttaccaaggcttgctgagctccacacaggctcacaggctgggccaagagactccggggattcattgtctgggtctaacacagtgctctgggccctggcccaggggagctgaacaaagtcgtctcaagattacaagccatttcagccctatcaggggttatggcccctactttttaacatcctgcttttatttgcaggctatgaagtgtaatagttcaccattttggtttaagtatcaccataaaagtcagtgagatggaacaggcaataagtagttcttttacatagtgtggctgaggctgggagcttacatcttcattaacccacagaaacggctctggaataaaatgctggggtgggcgctccttaacgtcaacatctgtgaggacgaggccccctccttctaactccgtgtgccacactttgccccttgctggctctggtgctgaggaagttggaaaaacaggaaggaaaagagcagatcaatttcataagagcgattctgagtgtgtggatgaaacaccaagctttgcaatggaaagtgaaaaactcttctcaacacagatgtgtttgattagtaagacacccccagcaccatcctccaggcaccaagtactctgattagctgaagttccttatctcacaaaataagcatttccactaaaattagattaacaaataatacaaataattgtaggcttttgctgatggaaaatataagtgctcatgtcttccatccagaatctgtcccagagagatagagttggtaggcatagtacatacaataagacaactttattttacttagcagggtggcatgatatttgcctatatcagagtttctggtaagatttcctgcataacacccattctatggttttatgtgaaagaaaaaaagtttctcagtgaaacaatttgagtggaaatgttaactaaggacatttcactatacagaacttaagattcaaacagctaaatctgtttggtatgtatatgttggtatatataaaaaattcctaggattctcactgaacattttctcaaagaatatttcttggggttcagatttcatgcctcactgacataaaggaactgcccgcctcccacatcatgcatgcgcagaagattcagaactttaccccatccacaataacctaacatttgagcacaccagaatcaagaacaaaactgcactaaaacacaccacttaggttcccatcctaagggaaccttagggctgctctctggtcccatccttcttgcccaattctcagctccctacccctaaagtgataggataaggtttcatagccaagagatatattttatctcattttctttatagccgagccattatttcctacagaattattagtctacctcctttatcactctcagcccccaattccctatttccaattttacccaacagatttttttctaaaaatgaatagatctatccttgtcctacaaaagagatcattgaacataccttcttccataaccagtacttagtatgtccttaggatgcattcaggacttttctttcttttatataaattttcttaaggattaaaactcttcagagtggttatcagatttaatgggacctaaggaccacatgaccagaggacacccatgtcatgtagaagagatatatgcaactccttatttatatattcataccagacaacactaatgaatcatagaataatctccttcccttcattcctccacctccatatgaatccaaatgtttttctatgggagataaaacttattttccctctctatcttagctcttgctttctgaaaaaaaccagtaatcttgaaaagtgtttccagtctttctctttctcacatagatgaagtgatagctatgtggttatctctcacaaaacatgcatcattgcggccagagaaaccaattccctatgtcttgtaagctctttacagacatgcccatgttgaacagtgtctttcaagttgtcaaacatctccctttttggtccatagttacccttcacctgtatcatgtgtacatcatgaggtaatgaaggaaaaaagaacattattctccagttccaggggcttgagtcaagtgacactggagaagtttctgctctactaagtccatggctatgaaaagactattccttaatagtgctaaattgcaacaggacagtgcagaaaaccttgtctttggacacctaagagataatgcatgttgtctcaccagtaagtaaattcatgccaaacagaaaggggcaagtccattctttcatagcattaattgcaaaaccaatcttagtttatcatacaggcagctgcttctgtatcagcccagagtctattctcagcaatgggataacttgaagtcactcttgggcctcattgacctcttggaggtaaagaagagagctaagatggtagcctctgtcatccacacacagaaaagtcaaaccctcaacccagccatgataactgaacccttgaacacaccagaaccaagcactccacgacttgaacatacactcatcttcccacctggttgcagctgttgctcacatactgactcctatcttctatacctcctacttggctccttagctctaaatgataggatgagagatgcaaccaagcccccaaaactaagctcccataaaagcagacctttatcacatttgctctacatggctatatttctgattcactctcctccaccaattcatcgccctaaattccactttccctcaaatgtcccaacaatttttcattttctcacatttttcgcttttactttgttttcaaattttacatttctatacacttgactcactctccagaactattctgattattccattcagctgcggtgctttcatcagacttgtgttgatgctcccctgggcattctctggcctgtacttggggaccaggaagttgtttctttaccaaccatttatacaatttccagggatgttgctgcagccctattcttactgccaccttttttgtcaagaataacatttctaataaatgaatagcagcagatcctctccagaaaaatatacggggctctcatcagagtaccatcttattatcccttttcccaaagggatccctttgtgggcatctgtatcacttactatttttctttgcacttaaggaagcttggctttcgcatctttgaattattcctctggcacctttagatatgcaccaggcctcaaatgtgcagttagaatagtaaattttcccactagataaaggattaaatttgccacgacacatcccagattacccatatgggctggcttgtctccctcagtgtaagacactctgaaacacattgaagtccccaagatatgagtgtctaaatctttttgtgctgctataacaaaatgcttgagacttggtagtttatcaacaacataaacttacttctcacagttctggagtctgggaagtccacaaccaaattacccagaggttcagtgtctggtgagggctgttctctgcttccaagatggacacttgtttctgcatcctctggagcggatgaattctatctcctaaaaagggacaaaatgagcagacttgacttcccaagccctttacgatgcactaattaattcaagagcacagaggccttgtggcctaatcacttcctatagatcccaccttttaaaattgttgcattggggattaagttttaacatgagttttgaaggaacataaatattccagccatagcatatgagtaagacttagcctgttcccaatccttctgtgtcacagcacaacagatacccccttgaacttgtgactataactgtgatccattgccttgggcctcagacaacagaacagaaaactatcaagaccatgaaggtggggcaaagagcggtgggtgtccagaacttcaagcacgcaacatagtctttcttagattaacctcttgagacctccctagagagattacttttgttcctaggacacagttatcttaacagcattctcataactggatttcccatctacatttcatttcttcattctgtatggatatgccaccccaccagaggtaaatgtcctactgctgatttgtggatactttatcacttgatgtgcttctatctgtatccatctatttgtctgtctctctatttactaaatgatttacctgtgcagtattccagatgtttggaaatgctggaagtctgaactctgatttacagaggagatgttatgtaattcaacatgatttaaagtgtcacacaatctgtctatatttggaaatatctactctcctggcatcatgcagaaccagacacagcccaaggccttatgtttcctatttaacttaacaacctgcataaatgtctcttttacatattatcaatgtgtctttaatagtcttgcaattcttgaagcaatcccaatctgaataagcaaaatttttgcaggctgtggtatgtaaggatccaactggctcacacaaccaagtagaatttcaaaatacacatactagcccagaacagtgtctttcatgccttttgaagaacactcatttttaattgttgtatttgacatgtgttcaagaagaatggtctggtaagcgatctttttactttgtttttgtgttcgtttgacatgggatggggtgtggggtgtgatttactaagacaactcagtaaaatcctataacaataatgcgctttcttttttgtgcgatgacatattgttctccactctctctcagtaacatatctgctacaaatagtttctacaaccctccttgaaggcttccaacaaccacacagatgtctctatgcacagcattagctgtggaaagaaaaactgtgttaaagaagacattttccagttacagggaaagacagaaccactatcttagagtgaaagtaatacacggtgagtcccattgggatagccttggtgacccctcaaggcaagggattcagacctactggtatcatgtcatgtctgccaaagggatggctaccagtgagctgtaatatgaatggaactagaagaaaatggaacaaagaaacaagatggtcggaattattccccagaatgaataaaagtacccctcaagatcgcctatccctacattcattgaacagctttttaatacctgattcagtctttcctgcatgttaacaccatgaaagaagtggagaagatacttgataaaaagcagaagtaacttttacaccctaaaggtagaggcaactctgaaaattgattcaatgttctctggtttatacatctattgtttatgagtttaattactatgaattggttccatgagtttgatcatcagaacaagaaccaatcaagtcaatttcaggacatgcaaagttgacagagctgtcaatcaagggctcttttctttactctgaccaattggactccctctttgggggaatgtgaatcttgagcaaagtataaaaatttataaatcattggaacaaagtatttctggaggaaatctttgagactttccatgagtacctgccactgacatccctgaagatgtcctggtttctgtctttctcaaagcctggcagttcagctttttttttctttccactcctgtgagatatctactatatacttcataaactacatctttctatttgcttccatcagcctgatgtggattctatttcttgcaacgcggagaccataagtcattcaggacctgtaaggccttttctattcaagtaaaaatcgaggttcaaggaagccacaatttatttaactagatttcagatgcaggacaggataattaaccttttattagggaaggtatgagccctgcctcctcttcccccggcagagacaaacaattctcctcccaggcctgactgagcaatatgattatttgagcccacatgcatttgcacaggaaggagctgctggagcttgcccaggtggccaggccagcactgagtgctggagggcccaggaggagggctcctgcctcaccctgggcggtcgggtggaaataaactgtgtctaccgcctggttctggcagcaaaagcagcaccagcaccagaggaggttcggactccagaccccccgaaaccaggaaattccaagctggagctaaaattgtagctggccctcccagtcttgctcccagctcaatgctctgcaagcctcagcacagcatgtatccacacacaaagttacccacacgggttgaattatggaggcacagaactgttgaggccaaggccctctgtaacgctctcactctctgaaccctggggcaagaaggatccttcacccactgtttactttaatacttggactgagctggctgttaattttaaccgtggcatcagaaacagaaaactagcatttattattgtcggccagacactgaactagcgatttaatgaaattatctattcactctttccagcaatgcttctgtcaaagtaatattatccccattttacagaggttgcccagggttggttgatgtatgtgtgccaggtttgttggaatttgagctcatatcttttgtctctaaaagcctagttaactatttgatattttcttttttttttttttttttttttttgagacggagtcttgctgtcgcccaggctggagtgcagtggcgcaatctcggctcactgcaggctccgccccctggggttcacgccattctcctgcctcagcctcccgagtagctgggactacaggcgcccgccacctcgcccggctaatttttttgtatttttagtagagacggggtttcaccgtgttagccaggatggtctcgatctcctgacctcgtgatccgcccgcctcggcctcccaaagtgctgggattacaggcgtgagccaccgcgcccggcctatttgatattttctaactgatggaacacagagactttgcactaagattattctcaagtggcctttagaaatcataaaactggactgtaccactagacttttctattgatagagccaggaaatgctgttttctaggccaggagattttcctgtctgtcctggcaaagtccattgtcattagtaggattgatcagctcacaaaggatattacttgaaggagagactcctggactgagaaataggaatttaaacccaaccctcagctatgtctggacaacatggcttctaacacttacctcctttgtatcctcaacccttttgtttataagatggcatagcaatgtctactgtaacagcagtgtgcagttgtgaataaggcaatgacctaccaaaatcagggagggaggctatctgccctaatggagataagtttttatttcttacattgtcaagactctgaaaaaagggagggatttcagttagttttattattgttttcaaatcctctatggacagtgcaacccttgtaatctgcaagcgtgagatcctcccaatttttctacttctgcatgcccctagatcaagaaatttaccagaaaaatgcaaggctgctactagaaagggacttatagaccatgaacatcaaattgatcacttacaaatccagaaattgatacccttaaaagagaagtaacttatctaagatcacaaagtaaattagtggcagagtcaaggctaaagccaatctttctcacaggaattacagcacaaatgtaaggtggtattatactaatattgatggccgtaaaaagatcccaaatattttcaagaaacccaagcactaaactctggcccttggatggcatttactctgatggacgggacgttggatttaaattccaaagacttgtgctcaagtctttgggtactgataacctcctggggaaggaagacaagataggaatagttaattaatactgcaaggtagaaatgactgcccaagataccaacgcaagacatttcagaaagcagcacatgatgagttgtcaaattagtggagccaggagctaatgctctgagaaggcaaaggagaaccaccaccttgcctcctccatgaactccccagctctccctgcattcctgtggcttcttaagcctttaatcagtaacctgaacaagtgatttgcttgataattatatgtttatgaaacatgatatttgggggaaagaaaaagtgatttggagtcaatatacatgtctttacagctcatctttgccatctgctagttgaatgaccatgggcaagttcctttgcctttgagactacaccttcttttctgcaaagagaaaacaataatccacacttctcatgactgaaagttaaatgaaaaactagatagaaagcatcaaccatcgtgtttgcctcttgttgaatgtacttctttgtcttcggttagactgcaaactccttgagggtacgttcaggctttgtatgactcagcatctttcatggctccatcacaattatataaaaaaaaccttaaagaatataattggattgtttgtaactcaaaggataaatgcttgagaagatggataccctattctccatgatgtgcttatttcacattgcatgcctgtacaaaacatctcatgtatcccatacatatatatacctaccatgtacccacaaaatttttttataattaaaaaaattaaagacattattgatttgaactaactcaaacatagtcaggagagaggaggagaacctatcttgattttttaaaaaagaagaaggttggatttatactacctttcactgagtatcagccagagtgtgagctgagttttcttaacaattgatcataacttgagtccattgtggggcatcatcagttcaatgcatggtggtgccaataacctaagaaaaaatacttccctaaatatcttgaaacccacatgattttactggtgaccgctttaaggcttccatatgataagctccacaacatattcactttcaaggggcatgtaaactgatagaaaaccacacaaaaattcagtaaaatcctcatggcaaaacctgagtcacccaaaagaaaactaacatttatcattacagacataagtatgctatagcaagattaggtacaagtactgaatagcttatgaaaataattatatttattatcataaaaagaatgctttatcatatgcaacaaagagttctatattggaagaaacacacattcacagatctctgtatacagatatgtggataatattttccacgtacacacatgtcccaatatattttccacattttctacaattcccatcataaccagaaaataaattcatgcttattttccctttaccaaatcaatctagctagatagctggctagctaccgctatctatctattaactatggatcatcttaataaagagaaataaacttgagtttgctttctgattatgatgggaattgtggaaaatgtgggggaaaaaaatgaaatttttaagttagggtccaaacaggagacaaaaaccacacagcaatttgaacaggaaatgttgaatacaaagaattattaactataacatggaattacctacaaaaagcgaagagaattccaaacaacaaatgaatggaagaaaagaaagcagccaccagctctaggactaaggcagagaacccaaggaaggaacaaatatggaagacactccctttccagagttgacatccacatctggatggtggctgtgctgctttggcccactggatgagggaagagttccctgaggtgtgcacctctggggtgctggaggaagccgcgtaggaaaacgtcatgccccgggtggtagtgtggctgaaactccctggaggtgtgtgccactgggtgtcctgctgcccgcctccctccagctgcctccagccaggggagcaagacagaataccggaaccaggatgaatccctcgtcccagtccagtgtctctcctgcgccctctactgacaaagtgtatccctgtgtccacaagcaaaggaaaagtactcttgtcccaagcagggcaatgaagggtgaacgtgaagctaagaggcaaaagttgataacagcacatacaaaaaaatataaaaacaaataaataaagatcaccaacaatcccaacaaccaaaaataaaatcttctactgatatttcaaaaaatcttctataacctgtatttacttgggaggggtaatgtctttacatattttttaaacaactaagaacatgtgttaagtcaatttaactaagtttcttttcaatttatcataagatatgttttataactaaaaattatctttcacatgatttttattgggtgcataatattccacaagggaatacttatttaagtattgttctatttttaagtatttacatttttatttttttctttattacagataatgtatatcttgaataaattctttaaaataaagacccacagtagattttctggtttcaagtttcaaccatatttaagaatcctactatatatttttaaattgctcttcataattataaagccaacttatatttccacagaagcatacgtgaatgtccatctcatcacattctcatcagcaaggagtagtaccacatttaaatatgtattgttagatttttaaaaatatacaagttaattcttacatttttgatcactagtaaagttggcaattttttacatctttaagttccacttctgaatatttgttttagccatcttcttgaatttttggtgtttttatttttaatatgtaaaaagtaaaaagctatttgttaaaacaccaagacaattaatcaaaatattacagtatagaagtggaatgatacttttaactatgataaagggtgattttatcacacacaacaaattgggtagttgtgacaatgatacaaataaagagtttattttacatttttaaattttgttatatttttcgtataaatatatattctttcttataaccaggaaagctatatcttcaaaatacaaggatttattttttccaagttatatccatgaccatatttaatggataacaccagaggtatacctgctaaaaatcagcaaaaaagaacaatgtccactattattactaacattgttgtggaaattgtggtcaagggagaaatacataaaaaagacagaaaaggtgtacataaaggtaaggaaggacgaaatcattattcattcactatataattccaaatataacacagaagcatttttgtcttaagaaatattctaaggtctgtatgtaaggatgaataagtcacagtccgatatggtttggctctgtgtttccacccaaaatctcatcttgaattgtaataatccccacgtgtcaaggatgggacaaggtggagataattgaattatgggggtggtttcccccatactgttcttgtgatagtgagtgagttctcatgagacctcatggttttataaggggcttccccctgcccctttgctctgcacttctccttgctgccgccatgtgaagaaggatgtgtttgcttccccttctgccttgattgtaagtttcctgaggcctctccagccctgcagaactgtgaatcatttaaatctctttcctttataaattacccagtctctggtatttcttcatagcagagtaagaatggattaatacaccataaaaaagaatatttgaaaagaataattgataaggaggtggactaggtggtaaaccaaagaaaattcctccctgtatgtactaaggcttaatatcaaacaaagcactgcagatcattgggaagtgaagaattatgccataaatattactaagatgaattaacagttaaaataaacaatttctgtcctctcataccatataccaaaatacattttacatggattaaaatgtcaatgtgaaaagcaaaactgaacagttgtatagcatagatttactaatttgttaaaaccttgaggtaagtgacaagaaattggaaagctataaaagtaattgaacagattaaatatttctatgtatcctaaatatgtaaacttttaaatgtagaatgttatgtatcatgaaagtattcatgaagtaatattgcagatggaatagttttacatttgtttggttaataacatagataaatcaataagaaaaacataacaccgttatagataaaagggcaaagaacatgaatggaggactattcactaaatatgaactagaaccattaagtaaaggtgagaaaataagctaaacctcattaataatccaagaaaactctccctgtggtgaaagccaaaactgagcatctgcttgtcaacaagctagattttgttagaaccatctgagttactactcaaataactttcagacaatggcaaattcctcaactccaaatcctgtttttcttctaataagaatagttgtaagtcataactcctcaagtgtgtgtgtgtgtgtgtgtgtgtgtgtgtgtgtgtgtgtgtgtgtgacgaggcgaggccctaaataggcacccagacacatgggaacctttatttcttgacctttgtctctcccagggtagcctctaacaagatggcttggatttgttttgaaatgtcttctccagagaaggattcccaagaggcatcatgtagactaaacctttggagctgcttggcacaatgcctgccatggtcaggccctgggaaatgctgcagagccctgcaggggaggtgagactcaagagagagacccagccccaagcccaggactcttaatttatgtttctgctctggcctcagtgctgtgaacaaagaaactgatgggatttatttaagggagttgcctctcccctcccctcaacacccatctatcttccggaatagtggaaagagtgctagatttggagaatcccagttccttcagtttctgaatgttgaccttcttatctagaaaatggggtcagtaatttcttccttcctgttgctggattattgggaaaaatgtggttaatgtatagtcaattacgcaagatggttcagcctttgagacaaaccagacgttttggattcaaatcttgtttctgcaactttgcatccttgagaaagtttgtttaacctctctgtgctcaatttcaccttctgtaaagttgagattatttcttgaagaattattataggagttaaattacgtaatacacccaagcattgtagcaagacctggaaatagtgttattattactagtgctcccagtttagaaattcttattccagcattccttcctacattctcttcttaattcaaccctgtctaactaacatgctctctttcccatttctgccaagcatcgttttatattttatattctttcgatatttgatgccatctgacataacgaatgacattttcctagcataattgtcatgtatctgaggtccaggaccacattcactcattcattcattcatttattcatgcagcaaatatttatctaccatctacagtgtcccagaccttgtcctagactcttgaatacattcatgacttcaagtcagtcctgatcatttaaatcctagtgttcaagttctaacttggaagtcaggcaagtaaccaaatgatttcaaaaccaagtcataagtagataatagagtaaagaaaagaaccttatgggaaatagagctggatgggattcactcttgctataagaattagaaatcctccactgggtcatctagccagggatctgaatgtacccagcaggcaaaagagagaaagagtaccccagatcattagaacaaaatgttaaaaagcatgaaggtgtgaacgtgtatgacctatataggaaaggtgataaaggtgactctggcaaaagtatagggtatgtgagaaaaaaaaagaaagagaaaaaggaaaaaaaaatggctacaagaagtcagatggaaaaaaaaaggcaaggagaagaagagacttgaaaaactgggttaaggagtttggacattttcccagacattcagggttttcaacatgtggccaccaggcggtcctgatctagtcaggtctgtgcttttaaagttttcatggaatatagggcatgtactacctatttagccacagaacccaccatgccataggacagtacccagcactgaatcttttcccacatgcccctgatggatgtaagtttgcaaccctgcttagtcttagagagttgttaaagagttgataccaggcattgattttatccagtccctctggagactggcaggagaggctattgtatgtagaagggatgtgagactataggaggaaagggcagctaaaaaaactaccacaattaaatgaaaatgatagaaattatgtttgcaaggatgtagactagctaaaaaaagtcatacattataacttcaggaattgtcaattggtataaccactttgcaaaactttttagcaatatttattaagctaaacatctgcagaccctatgacttaataattttatttccagacatatgcccaacaacgctgtgtacatgtgtgtacacaaagtcatgtacatgtgtgtatataaagtcacgtacaagactacacagcagcactattcataataacttcaaactggatactgcccaaatagagagtaggtggtggataaatatatttttgtatgttacatataacctgagcacggtataattatgaacaacaatatggttaaatcttataacatagtattaagtgaaggaagacaaactgaaaaggtcacatgctgaatgaatctgcttatacaaggtacaaaaacaggcaagactgaaagttgctcttaaatgatgattacctttggacaggcaccagtgtttgtctggaagagggcaacaagagggcttctgggaagctgataatgttctatttcttaatttgaaaactggtttcatgcatgtgttcagtttgtaaaaaagtattgagctggaataagtgtgtttatgatatacgtatctttctgaatatacttcaattaaaaagttttacaaatttaaaaaataagttaaaggtcatcacaaataatattattgcagtagacagtgagaattaatgagacctgtaccagggaaataagtgttgtatttactcatttgtttatctagtcattcattcaatttttattaagagtctgttatggatcaaacgttctactaggtgttgagcataccaaagctacacggagaagagagatattaaacaatcaacctctcaactaaataatttcaggaagaaaaaggcaattaataagcaaagcaaggtgatgagatacagcagaaatggatagcagtaggggatgttggagaggagaggctactttagacaaattagcaactgtgtttcccccatctcaggctgctaggactaagcacttctgcacagttagtggtgttaaaactcctaggattcttgttccaatgccagcagatttttcgtcttgctgatggtaaagcaggattttgataaagcttccttacaaagggtgtcacatgcaataatgtgtcatgatcaacatgtcacagcacacagcaccaggctggtacgatctgacgatccagggctcataataccattattgggcactgggaagtgtattttgctgtgtcttgcaaaatgctcaaagaaacactgtctaccactccttgacctacgttttataggatccttagttgtctgcctccaaagtggaaaatattccatgggtaccctgatagcatatttaacatgcctttcatctcaacatttgttttctggattgttgctccatccaactccctggcacttctgaacataattggtattcctttgttaccaagactttttccacaaactttacttttgaaatatttcttaaaactttttttaatttttaatattcaaataatttcagatctcacagttagtccaaacatcccactaaatctgatatgagttagagagctcattggaagaaaagggatagaacatatattttttaagaaggaccaacattaaaattgaaggtttttgtcttctattaatatcactggagcctctaaaaataaatgtgctatataaatgtaaaattctcatcacaatttttcatggcagaacatgtagtaaagacaacttgaaaatatctcagctttacggaaggagttattgccaggtttgattttgtttaatcaacactggccctccagtctatccttgcatctccaaagcctacatatttggaggacccaccttagatactaacacttgtagaaaacctttcctgataacctaagccaagagtgctttctgccagctaaactgctgtacctgttatttatacctttctcacaatcaactgtgtggtgacgtgtctagctctctacctggctgctgggtgtgagtgtcttgatgtgtttaagttatctctgcatcttgcacaaccacagcatcatcaccgtcatcatcaccttcaccagaaatacccactgagcacctaccctttgtcaggacttagctcagtgctttaatagccttatcttatttaattctccaaacaaccttattactactcactttttacagatgaagatatgggagcatggagaggctaaataacttcttcagtttcctcagtgttagaactaaaactccaggaatatggctttagcatagactcatacctgtggtgccacggtgcttcttacctagcaaaaacgaggcatcatggaagttcataaacacccgttcaatacattggccctacggcatgagagtggctgtgaattagtttgggcagaaaaacacaggaagtgagtcgagcctcacggatgttttgtggtgagtttgagaaacattgagggtcttcatttcaagatgaccagtgacctgtttgcttaactggggtctgtgacaaatactctaagcacctcatgtttcccgtgagcatgacaccttcaatcaaatgttcacaaagccaccgtcacatgtaatgcccacccagctgctggtagaattccccgagtggtacactgtgaagacaggtgggattctcgggatgaaaaggatgcacacttaagcagttggcagagatttgctttctccattccctttattaactcccattgacttccattgtaaaaatgaagatgcattcccatgggataaaacacttggcctcaccactagacaaaaatgacctgtacgaaggaaacaaacccctttcaatcagctgtttaaaggaaaaatgataatggatgaaagaagttgaaggaataatgatcatgatctttagaaagcaatgctaaactacataaagcagaggcagaaaaaaaacataccttttagaaaaaaaaatgcggagacagtaggtccatgaaaagaattgaagcaaacatggacgttcatttattcatttactttttctactcatttattcacttattcagcacatctcactggtttgtgctgtttgcgctctgttctacatagaggagagaaggacaaatgagaagatactcaagaagtgagacacaggagtccctgtgttcgggtggatatgaaggtgttacagcacagtagttatgacgcagattttagcatttgggaaccagcatagcacagacttgggactggaatcctgttctccagcttatcagctgttgcctttagcaaggcatctgacctcactccacctcagtttccctgcttgccatgtaggaaagagtttctgacatgaaaaagttgttataaggatttgtatttgtatatcacttagaactaaaaagcaaatgctgttttaccatgtgttatctgaatgagttggagcaaaattagtttattcaactgtaaaataggtaacttgtacatctcaggataatgaaagttatacacatacatatatatatataaatatgtcacatacacacacacacactgaaggaattcagaacatgccaccccaaaatatgttgccctggcatattgactattctgagttaaaggaacttgaaaaaccgcagatccaagaaggacactctgatcttccttccatctctcaaaagagagagatgaaggccggacgtggtggttcatgcctgtaatcccagtactttgagaggccaaggcgggcggatcacctgaggccgggagttcgagaccagccagaccaacatggagaaaccccatctctactaaaaatacaaaagtagccgggcgtggtggcacatgcctgtaatctcagctactcaggaggctgaaacaggagaatcacttgaacctgggaggcagaggttgtgatgagccgagattgcaccattgtaccgttgcactccagcctgggcaacaagagtgaaactccgtctcaaaaaaaaaaaaaaaaaaaaaaaaaagaaacagttctctaatttgagaactgtccccgctataccaagagaaaggaaacattcttatcatggaggacaggaaattgagaccaagagaattctgtgcaaacagatccttgttaaaataagtcttatcttcctttagccttgccaccattgccctttttttgttcaacctagtataagagcgtttaggttttgccaggtctttgagtcttcatttcctaatgaggtctcctgtgtcttataaaatttatatttaaaattggtatgcttttatcctgttaatctgtcttaagccaaattaattctcaggcccagccagagaccctaagacagcagaggcaacaaagttttgcttcccctacaatatataccatatataaacacacatacatacagagatgtgtatgtgtatgagggtgtgtgtgtttgtgtgtgtgtgtgtgtaaaatacattatataaatacagtcattggccacctaatgatgtttcagtcaacaacagactacatatatgacagtggtcccacaagattataatgaagctgttattgtccctggacagggggacagtaattttgttgatctcaacccggtgtagggctaggctaatgtgggtgtttgtatcttggggtttttttttgtttttttttttaatttgagacagagtcttgctctgttgtccaggctggagtgcagtggcaccatctcggctcactgcaacttctgcctcctgggctcaagcaattctcctgcttcagcctcctgagtagctgggattacaggcaggcaccaccacgcctggctaatttttatatttttgggagagacagggtttcaccatgttgatcaggctggcctcaaactcctgacctcgtgatccacctgccttggcctcccaaagtgctgggattacaggcatgagccaccacgcctggcctgtattttactttttaatgaaaacgtttaaaatttttttaaagttaatagaaaaaaatacaaagatctaaataaagtatttttgtacggctgtacaatcggtttgtgttttaagctaagtgttcttacaaaaagtttataaaagttacagtaagctaaggttaatttattattgaagaaaaaaatatgattgtatgaatttagtgtagcctaagtgtttggtgtttataaagtgtatactctgcacagtcatgtccttgtctttcacattcagtcaccactcactcactcactcactcagagcaacttccagtccagtaggctccttttatgattagtgctttatacaggtgtaccattttttatcttttatacgatatttttactgtaccttttctatgtttatatatgcttagatacatgaatacgtaccattgtgttacaattgcctacactattcaggacagaaagatgctgcagagatttttaggctaggagcaataggcaatgccatatggcctggcatgtagtaagctctgccacctaggtttgtgtaaatacactccatgatgttcacacaatgatgcagtcacctaatgacgcatttctcagaacatttccccatcgttaagcaacacataactgcatgtaaacggcttgacgcagcatcttacacccagcaaatactcaagtggctaaatggtaagctctaagacaagctctatctatatacctatgtatgtatctatctaatttatataattttattttattaatatttagtgggaaatgagagaggagataacataatttttacacattaaaaaaaatttgtgctaagcccctattatgtacaaggcactgggaattcgataatgaaaatgacaagtgtggccactgacctcaagggtacttatagtcagtctttctggactgggcagatgaaatacagatatgttcagatacagaagactgggggaaaagaaacttggtggaaaaatgtattaggtcagttaggggcatatgagggtaagaggaggagttgacaggaacatactcaggtttgaaatttagagtgggggaattggatttattatagatttggaggttatcaggagttggatggtggaagatgagatcacccagattgaacaagtgtagtgagacgcaattctagcttaaaaacagaactcttgataactcaaccattttaaaatgcaaataaagaaaaggatccaatgatgatactgagggggaaaaaaagttgaaaaaataacagatccaagattctacaaaaaatacagacagaagggcagaataatcagggtcatgtggttgcagcctaggaaagcaaagacatttatcccagcagccaagagagtcacacaggttttgttacatacttgattttacagcaatttaaaaagccagactttgagacacttcctatatcacgaggctcttgctgtccagcagaatctcatttcctgaaatttgtgcacatttggctcctaataactcctcattttatagtttacaaagagctctctcacatcttgactaggcctcaccactgagaatcaggcaaggtctgatcattatctccacttacagatgaggaggaaatgggttgagagaggcaaaagcatgtgtctgaggtcttgcagatttattgacatcctgcaacacactcgctattctctccctgaccctggccttggagaattgtgtcttctgaaatatattctcagaaattatgctctataccggatcttagaggggcattttggatccacataacccatgacatatggaacattaacttccttaaatctttttggaagtgaataaatagcaaaatgagtagggaattaaaacagatattggggcattttcacagtgatggagagacaaaggcagataaacacatccctttgtgtcattacatcccatcctctcctcctaccccccaaagacagagcaattaggctgagtttccagggattgcctggcctgtgtaggtgctgcgcaccctccatccagtgacccagtacaaatgccgtctctcgcagcttcacagaccgctgctgctgacttaggcctcggctctgactctggttcccttcctcctgcctttcagtcagattttcccatttccgaagtcaacagcttccccaaagcaatgggacacaggacgtcataactcagacgccaaacagcaggagccaggagggagggaagaaaggaacacaatggaaatgggtctgcagaggctgcgcagaaggaggactggagtgggagtctaggggagattaaagcaagtgcgtgacgctgagcattgttgggcacaaaagccactgtgtttggtgtccagttgatatctcatgtttaaagtccggggtgtatgcacagaaggtgggatttagaatctggacaatcagactagggggttggaggagctaaaaccagccccttcctggacagagatggtccagaggtgggcagaggcaggctccaagaggacactggagtgctgcccagtaaactgaggcctaagcacttgtgaatgaatggagcccagaaaaaaggtagcagatgggggaggggagcagtttcaggctgcacaccaatgcctcgatgcaaaagacaccaaggacctggcagcagactcctttctctttccacaacctggtgggcctgtgaggttgctcaggttaccttgtatctagtagcagccaggtctcagctggaagaagccacaagtgaggaggcagggcctcagagaagagcaggggccagtcattcgaggcacccaaagatgtcctggaagggagctggaggatctttctagaactcccaattcaatgtgttgaggtgtctcagtcctgtttcacaggacttttaaactaatatggcagacttttggctgattgtaactgagtactttaaattatgtagatgactatattttttttcacttaaaaggtcagttcttatataacttgcctcattcttttcaaaaaatattttcatatacccactaaatagaatatatagaaatgtatgcataaagcatatatacacacacaaagaaagacaatcttcatatagaaaaaatataatacgcattcttaagtgtactcagcacccagatccagaaatagaacataccagcaccctagaagtcctgatcatacttaactcttaatttaaaaaaaattatctcagcaactgccaaccccaagaaatacctttccaatttaggttgaaaacaaataaggaactgcaatacagtacgtgggttttcactctgtggcacactttccatacagatctattctgcaaagggaattacacctcatctccagctcacccaagaaagcccatggagattcacgctgattacacaaaacggatccatagcattagcagtggctgttctgctccatggtcgttcagaagtcagccctgcgtctgactgaatggcctgagtcctttagtataattactgtcgtgtacatcttccttccaagctctgcagcagcagccagcgtggaaggggagatttccacaaccagcacttatttctgtccatgcagtttccagtggaatacttagcagcatttcctccacagggcagggcaccttggaattactgtctgcttccagggagttttgagctcagagtctctgctggggattgggatgggacagggagggtgtacaaacattcctctgaagtagtgcacaagattttcagcatttttcgagggagcgtctcaaagttacacaacatccccacaccctgcccttccccctaaaaggttaagaacctctttacttgactatgagttatctgagggcagaggcattgattaatcttcttcaacctgtatccacagtgagatttttttttctgtattaccagccatcagcctgtgtaactgaaaaaagctaggaatttggggtcagacacactgtcatcctccgtgtaactgagtaaatttttaaactctctgagccctcatttttttcatcagtagagtaactataataatgcccactacactgtaacattatatatgtctgccagagtgcttggctcattaaagaatttctgcaaagtccagctatcctatctccctacctctctgataaatccagagcaagctgagatgggaagaaaggttgagctcacagttatccggatgtttcagactcacaaccaatatgaaattgaggctggccacgggatggcaactccactcagcatagccacggagtagcagtgagagcactgtgtcccttgatgttcagcccataactcttcaaaaggccccttcttggtagccctgatcagttctggtgtgcagtctgtcaagttctggattgccattttagcacggcacccatgttttgagagcaggagcttggtctgattccaccactgcacaaggctaggcacactgcaggtgttggataaatgccagctgaatttacagattttaataatgaagtctacggctcaatttaactagaaattataagtaaaatagcatgttaaaccctatatagttctttcgggcccccagaggaaaggacaggtagctttcaacagactatcaaatggagagaaatgttaatctattccttaataatctccttatgtctttatatgcaaaaaactccccaataggtgtgtgtttcaggggaatcatcagaccctcctgctcaacgcctattgacttacaggtgctaaatacccagtaagttgctctctgttctacttaacaaccacctaattcatccactgttccagacttggaaagagatgattcttgtcctgaggttttctccaacagaaagggaagaaagtacatcagttaataattcttagtatttgatttagagtttcaagtctataaccatcaagatagcaattctaagaggcaaaaaggcaaaaaaaagtagtctgtattgaaagcaattataatggccacaataatatcaataacatctaccgtggatgaacgcatttgaaatgcagagtaaaggactaatcatgaatcatctcattgtattttctcaagaaggaagtaaaataagcatgactttatttccacttctcaaatgtggaaacttgatggagagaggtcaagtgacttggccaaggacacagttacaaagtcaaaagtccagcctagatctacctgattctacagcctctgctgagaactgaaaccaaagtcaggcaccttgtcatacatcaatatcattaatggtgccaggagtagactccattattctgaattcctaaatccaaattttacacattgagaggatctgtagatttgcttctacagctgtatagattatccaattctgatttttaagtcaaatcacacaatggctgggcaggcttccccaaaccctggcaaagttttcattgcccacaagatggcgttgaggggtgaatgaaaaacctccaggcatggatgtcctatgtgcaccattccatcagaacataaatgcactggcattttccagcaagatctgttaacagttttggaccaaggaaggagaaggggcctcgttagatctatcactatccagtcatgtaccacgtcctgcattaacgctttgcatctgtgactccaaaacaaagtctcagaaactccctggtaggtgtggcaagtacgtgacaatatgctaaactaaactcaattggtttaacctccagttccttaggagtcctgggcataccttccttacttgaaattacacgtaaccttggttggcacacagtaggtgcccaatccgctgaagaattgatgaatgatgtttcattcaataccttgaatgctggccttctctggataaggattggctaaattttacatccagaggttaatgaagctgtcattgagagttgaggttctgaggaagaaagactaaggtctgctggaaagacacctggaccgtgagaagcccaggtgtgcaactctagttctgagccttagaacctttgaacaaatcactgagtctcaaggtcctcatctttaaaatattcatgtttgccctgcatagtttctattgaaataatcaaatatgctaaggaatgaaaattgctgtacagaaaaatgtcactattccaaatgtaaaattctatactcaggaagggagcagttattgccttttagtaggtgacactaaagttggtcatgcattaagaatctggagtcagagctgaatctcagcgacaccatttactagtagtgtgaccttaggtaaataatgtaactctatgacccacagtttctacctctataaaatgggggtaagaatagtataagcttcttggagattaggacagaggtaaaaataaagtatttatcaaaatgcctagcacatagttaccatcaaaatggtactaatcataatattaatattatgtgtacaacttttaatttatgtatatcatgagttatgatattttaaacatagctcttactgactcccatgagccaattgcatgcatgtcttttcaactttgtgttcagcagcaatcacattggcagcttgaaaatggctgtagtaggagttatttacactactactatagttgtgtagtataattgataaatgctacaaatcagaattgttgtttattgttgttttcattttcttccagagaatcaatttatcagtatcaaccaggcgtggtggctcctgcctgtaatcccagcgctttgggaggccggggcaggtggatcacttgaggtcaggagtttgagaccagcctggccaacatggcaaaaccccgtctctactaaaaatacaaaaattagccgagcgtagtggcgcatgcctgtaatcccagctacttgggaggctgaggcaaaagaatcactggaacccaggaggcagaggttgcagcgagctgaggtggcaccactgcactccagcctgggcgacagagagagactccatctaaaaaaaaaaaaaaaaaaaattaccagtatccttttggttatgcatattgaatgtgtcttagtttaggtctcctagaagcatttcctaagctgagattcatatgtaattgagctattgaaggagtgcccccaaataaaacttgcaagtgtgtgagggaagccttatagggcagaggaagaaaccgggcaaaggtgagggtgcagctgaagtctagtctcagcctcattccacaggcagctctggagcctgcgtggaaccacagagttcccaccttgaggcaagggtgccaaacttttctgcccttgtgttagttggccattggctactgacagacttctggagagaatgcagcttcccaggccattctgggtggcacagctcctgatagcaagtaattctctgaagggtccagctgtgagtcaagaacatctagcactgatgagacatggatgcaccagcccagcaaagggcagctgagcagggcaccaacagcacctactacagtatggaaacagattgtcatactagacatttgaactagaatagatttgggaagtcacctctcctatgtgtgtaatccaatacagaagagttgcttattcaatcagcaaatatttatttagtgtaaactacattcctagtaatgggattggtactggagatgcagggctgaatgcaatcagatgtggagtcccggcactggaggagtttacattccagctatggagacagacattaaccaaatgctcccacaaataaacacacatttacaactgtgatggttactgtgaaagggacaggaaacatagtactcttctgtcaagacaagggtttgatagacagggaggccccagagagcttccctaaaaaagtgacatctgaactgagatctgaaacatgaactcactaggtgtgggagtaggatgaactagaagtgggaggagctgacagtagacaggtaagtgaaccttcccttggactcatctccaggacaagcttgcgtatggagatttgtccctgaggcccaaggagtgggatggctcctggagaccacgggggtggggaaatgaggaagcaaggagagttatctttactcttctgagaacagtacttagaaggcaggccaacccttttctatttctactaatattctagaattctctattttgaaaacaagactatttttatcctctgtcagtcctctgagcccaagccaagccatcgcatcccctgtgacttccaggtatatgaccagatggcctgaagtaactaaagaatcacaaaagaagtgaatatgccctgccccaccttaactgatgacattccaccacaaaagaagtgtaaatggccggtccttgccttaagtgatgacattatcttgtgaaagtccttttcctggctcatcctggctcaaaaacacccccactgagcaccttgtgacccccactcctgcccgccagagaacaaaccccctttgactgtaattttcctttacctacccaaatcctataaaatgtccccacccttatctcccttcgctgactctcttttcggactcagcccacctgcacccagatgaaataaacagccacgttgctcacacaaagcctgtttggtggtctcttcacacggacgtgcatgaaatttggtgccgtgactgggatcgggggacctcccttgggagatcaatcccctgtcctgctctttgctctgtgaaaaagatccacctatgacctcaggtcctcagaccgaccagcccaagaaacatctcaccaatttcaaatccggtaagcggcctctttttactctcttctccagcttccctcactatccctcaacctctttctcctttcaatcttggtgccacacttcaatctctcccttctcttaatttcaattcctttcattttctggtagagacaaaggagacacattttatccgtggacccaaaactctggcgtcggtcacggactgggaaggcagccttcccttggtgtttaatcattgcaggggcacctctctgattattcacccacgtttcaaaggtgtcagaccacgcagggatgcttgccttggtccttcacccttagcggcaagtcccgcttttctggggaaggggcaagtaccccaaccccttctctccttgtctctaccccttctctgcttttctgggggagggacaagtacccctcaaccccttctccttcacccttaatggcaagtcccgcttttctgggggaggggcaagtacccctcaaccccttctccttcacccttagtggcaagtcccgtgtttctagggggcaagaacccccaatcccttatttctgcaccccaacctcttatctctgtgccctaattccttatttccatgccccaaccctttctctgcttttctggagggcaagaaacccctaccgcttctccgtgtctctactcttttctctgggcttgcctccttcactatgggcaagtttccaccttccattcctccttcttctcccttagcctatattcttaagaacttaaaacctcttcaactctcacctgacctaaaatctaagcatcttattttcttctgcaatgccgcttgaccccaatacaaactcgacagtagttccaaatagctggaaaatggcactttcaatttttccatcctacaagatctaaataattcttgtagtaaaatgggcaaatggtctgaggtgcctgacatccaggcattcttttacacatcagtcccttcctagtctctgtgcccagtgcaactcgtcccaaatcttccttctttccctccctcctgtcccctcagtcccaaccccaagcgttgctgagtctttctaatcttccttttctacagacccatctgacctctcccctcctcgccaggccaagctaggtcccaattcttccttggcctctgctcctccaccctgtaatctttttatcgcctcccctcctcacacctggtccagcttacagtttcgttgtgtgactagccctcccccacctgcccagcaatttactcttaaaaaggtggctggagccaaaggcatagtcaaggttaatgctcctttttctttatcccaaatcagaagcctttaggctcttttttatcaaatataaaaacccagcccagttcatggctcgttcggcagcaaccctgagacactttacagccctagaccctaaaaggtcaaaaggccattttattctcaatatacattttattacccaatctgctcccgacattaaataaaactccaaaaattagaatctggccctcaaaccccacaacaggacttaattaacccatcttcaaggtgtacaataacaaaaaaaaaagttgcaattccttgcttccactgtgagacaaaccccagccacatctccagcacacaacaacttccaaacgcctgaactgcagtggccaggcgttcctccagaacctcctcccccaggaaattgctacaagtgccagaaatctgaccaccaggccaaggaatgcctgcagcccaggattcctcctaagcagtgtcccatctgtgtgggaccccactggaaatcggactgttcaactcacctggcagccactcccagagcccctggaactctggcccaaggctctctgactgactccttcttggcttagcagctgaagactgatgctgcctgattgcctcggaagccccgtagaccatcacggacgccgagcttcaggtaactctcacagtggagggtaagtccatccccttcttaatcaatatggaggctacccactccacattaccttcttaagggcctgtttcccttgcctccataactgttgtgggtattgacggccaggcttctaaacttgttaaaactccccaactctggtgccaacttagacaatactcttttatgcactcttttttagttatccccacctgcccaggtcccttattaggccgagatattttaaccaaattatctgcttccctgactattcctggactatagccgcatctcattgctgcccttcttcccaatccaaagcctcctatgcgtcctcctcttgtattgccccaccttaacccacaagtataagatacctctactccctccttggcgatggttcacgcaccccttaccatctcattaaaacctaatcacccttaccccactcaatgccaatatcccatcccacagcacgctttaaaaggattaaagcctgttatcactcgcctgctacagcatgggcttctaaaacctataaactctcctttcccttcccccattttacctgtcctaaaaccagacaaggcttacaagttagttcagaatctgcgccttatcaaccaaattgttttgcctatccaccctgtggtgccaaacccatacactctcctatcctcaatacctccttctactacccattattctgttctggatctcaaacatgctttctttactattcctttgcacccttcatcccagcctctctttgccttcacttagactgaccctgacacccattaggctcagcaaattacctgggctgtactgccgcaaggcttcacagacagccgccattacttcagttaagcccaaatttcatcctcatctgttacctatctcggcataattctcataaaaacacacgtgctctccctgctgatcgtgtccgattaatctcccaaacctcaatcccttacaaaagaacaactcctttccttcctaggcatggttagtgcggtcagaattcttacacaagagccaggaccgcaccgtgtagcctttctgtccaaacaacttgaccttactgttttagcctggccctcatgtctgcgtgcagcagctgccgctgctttaatactgttagaggccctaaaaatcacaaactatgctcaactcactctctacatttctcataacttccaaaatctattttcttcctcatatctgacgcatatactttctgctccccggctctttcacaattaccattgttcctggcccggactttcacattattcctgataccacacctgacccccatgactgtatctctctgatccacctgatattcacaccatttccccatatttccttctttactgttcctcaccctgatcacgcttgatttattgatggcagttccaccaggcctaatcgccacacaccagcaaaggcaggctatgctatagtacaagccactagcccacctctcaggacctctcatttcctttccatcgtggaaatctgtcctcaaggaaataacttctcagtgttccatctgctattctactactactcagggattattcaggccccctcccttccctacacatcaagcccaaggatttgccccccacccaggactggcaaattagctttactcaacatgtcctgagtcaggaaactaaaatacctcttagtctaaatagacactttcactgaataagtaaaggcctttcctacagggtctgagaaggccaccgcagtcatttcttcccttctgtcagacataattcctcagtttagccttcccacctgtatacagtctgataacagactagcctttattagtcaaatcagccaagcagtttttcaggttcttagtattcagtgaaacctttatatcccttacggtcctccatcttcaagaaaagtagaacggactaaaggtcttttaaaaacacacctcaccaagctcagccaccaacttaaaaaggactggacaatacttttaccactttcccttctcagaagtcaggcctgtcctcggagtgctacagggtacagcccacttaagctcctgtatagacgctcctttttattaggccccagtctcattccagacaccagaccaacttagactgtgcccccaaaaaacttgtcatccctactatcttctgtctagtcatactcctattcaccgttctcaactactcatacatgccctgctcttgtttacactgccggtttacactgtttttccaagccataacagctgatatctcctggtgctatccccaaactgccactcttaactcttgaagtaaataaataatctttgctggcaggactatgctgaatctccttaggcactctctaatcagatatcctgagtcgtcccaattcttagaccttttatacctgtttttctccttctgttattccatttagttgttcaattcatataaaaccatatccaggccatcaccaatcattctatacgacaaatgtttcttctaacatccccacaacatcaccccttaccacaagacctcccttcagcttaatctctcccactctaggttctcacgccgcccctaatcccgcttgaagcagccctgagaaacattgcccattctgtctccataccaccccccaaaaattttcgccgccccaacacttcaacactattttgttttatttttcttattaatataagaaggcaggaatgtcaggcctctgagcccaagccaagccatcgcatcccctgtgacttccaggtatacgaccagatggcctgaagtaactgaagaatcacaaaagaagtgaatatgccctgccccaccttaactgatgacattccaccacaaaagaagtgtaaatggccggtccttgccttaagtgatgacattatcttgtgaaagtccttttcctggctcatcctggctcaaaaacacccccactgagcaccttgtgacccccactcctgcccgccagagaacaaacctcctttgactgtaattttcctttacctacccaaatcctataaaacagccccacccttatctcccttcactgactctcttttcggactcagcccacctgcacccaggtgaaataaacagccatgttgctcacacaaagcctgtttggtggtctcttcacacggacgcgcatgaaatcttcatattttctcagattggttattttctgtttttctttgatgtttagaaaagtgccttttgaaaatccctgcctgatttagcccaagaaaagtcggggtggggggtgtccttactaagtcctaaagttaaaagtcaggaggatgacagatctctatatttacatgggtgtgtttactgcacatatatgtgtgtgagcctgtgagcacatgtgcatgcatgtctgtgtgtgtgtgtgcatgcatgtctgtgtgtgcatgtacatgcttgggtatgcatatgagagctgcatggatgcaagtgtgtgtagctggtgcttgtgtgtgcagtgtatgtgtgcgcgtgtgtgtcatgtgtctgctttagtgatcagggctgggaggtagagagtggaggtgggggagaagaaagcaagcatgcacagggcaagtcctggagggaggaggaggaagggaagtgctcattgctgctgctcagcccattattaaagagaaacaacattcccagcaggaggcagaagggcaataaaaccagtggctccacaatttatgatgctaactgagattccatagtttgaaacaagactatcccctggagcatcaaggtcaacaagccagcaatgccctggcttccaaagagctcccccgtgcccacctattaatcagcccattgctgaaagtgcaccaatgagctctgctctggaaacatcattaataagcagggacaggccagattgctaaaaattccaggataagggcagaaaggcatggaaaaaaatatttatatacacatatgtgtgtgtttgcatatggggtgtagcctattatgtatattgggccatccattacaggggtcatatataagtgtgtctcttcattttccatatattttatattatacgagaaatgttcagcctttagaaccttgccagatggaattagagcaattgttcttctgccgagactttgggaaattaatgaggttcgcacgcagagccatgagaaaatagaattttttttaaagaaggaaagaaagaaaggaaagaaagtgccccgtttccaaaaatacagcagccacaatcccagagagagctatccgtttagtggctaatcttgaggcccatcagttgccccagcttatcttttgggttattgcaattctgaatggagctttaatcagcttagcccagcctgggcgccacgcgcctgccggcaaagggcattttcctacagatcctctggaaaccgtctcctctgctcttaataaatggatcattctctctctgggtccatcctggaatgcagcgcttaactttcttttgtgttcaaggaaagaaaaagagcaattatagggaggaaacccatgcactctgaaccccaaattgaaggactgagcattttctttataccaaggcttcaatattgtctaggaggttggaccccaaattggaagtgtcattcccaaaaatgtgtttctgttttactgttctatcaacaaaacttttcctggattctctgtccctgtcagagaccaccctgaaaaaggactctgtgcaacttttgtcactctccaagccccctgggacaagcctttggccaacatggcgacctcccattctgatggctcccctacaatgcaagggggtgggacgagagcccagcgctgggtctttgcctcatcagatgagcaagctggtcccagatgaaaccactgctggcttgcctcctgctctgctccattctatgcctccagtttggaacaggaagggatttttgtcagcaatcatccccaaagggtgttttcctattgcttaacaggccccagaaccagaaatgctgtgcattttcccagctctttggctccctgcagccctgtcttctgtttggagctgtctcggagggaacacagaaaatttacaatatgctgtgtttgttctgaaacaacagaaaatggctctgaagcggagctttaagagactattcttgctagcaatgtagggaagggcatatatattcttttgtatatgcatgcattgagatgatatgtgggagattgtttaagctgccctttttttgagcatgtactgtataccagcagtatatgttaagcatttatatccatcatgcaatatctttgatgaaatggagactcaaaattttccaaggtccaagaactggtgagtgtaggagttggggtttttcaaccaggtctgtttgatccagagtgggttctgtgtccccctgagtcctgttccagggtcatcaaatgtcagaacttccaatagaaaaagataagctcactaaacagtgcccttttgcagatagacaattgatcttgtcaattactaagtagtagaaaggagaccagaacccaagtaatacagggatcttattctgtgtttctgtgtgtttaaaaaacgatgaagtggagtggggaggaaaggctccctccctctgcaccagtctttgcagagggtccttaccttcctcactgagtaaactcaaaaggcatctgctcaactaccagggctatgagtatgaattcattcattccattacccttaacacaccctgggcaagagtgatcacctgatggtgggaggacagcaattgaaggaccaaaggcagcctcagtccaagaaccagtgtcagtgctgagcctgagagcaagtgcctcatcataagagttcctgagagggctaaggccggacatggtggctcatgcctgtaatcccagcactttgggaggctgaagagggcggatcatgagttcaggagatcaagatcatcctggccaacatggtgaaaccctgtctctactaaaaatacaaaaattagctgggtgtggtggtgtgcgcctgtagtcccagctactcgggaggctgaggcacgagaatcacttgaacctgggaggcggaggttgcagtgagccgagatcaggccactgcactccagcctgggtgacagagtgagactccatctcaaagttaaaaaaaaaaaagagttcctgagacggctgggtactctgcacacacaggcaaactgagtgcagcttcctaagctagggtccccaggaatggattctgactcacggactctccagagagagggagacgctaagctgcagagccaagggaggtggggaggacagcagctgctattgttgtttctctctcgaccttattaaggcaagaggaggacccattgtgctcctaatgattgctgagatatgaggtatgttcactgagaggaagtagtttggttttaattaaaaacacagaccttaagatgagctagagaaggaaaaattcagggccaaccttcaaagcagcttttgggaaactgaatttgagttccacctaagtttcatgaccttgaatgagttatgtccttatgctttggttttgccattattgtgactggcatgtaagaatttttgttgatctacattgttacaaatatgggatttttcaacccagctctaagcagaggctttgcattccatggtatcttcatttattcacattgcaccttaaaagaaagagaaaggaaaccgatagtcattgataatttactctgtaccaggtactatattaatccagtttcatcctcatcttacatagtttcagccccattgatagatgagtggcagaaaggtttcaaatgttacctgatctcacacagctttaaactgaagaattgctgttctgatccaagtctgtcgaatctttgtctgtactcaaactgtctctgatgcttaacatcatgcttacacatttttacattctcaacaaaaaccaagggatgattctttccatgctccttggtactcagcttttcttgccctatatcatttccatttgcaaatgggccctgcttgcgcatttggaacatttatttgcaaattaacattttcacatccaactgttcacccacctctatgtacttaagtcaaaaagactgcaggacacttacgttatctccttctcacatgaagctaatgcctgaaatccaacttgtccttgggcctatagctaagtccatggagtagaggaggtgccagtgatggtggcttggtgcagcaaatgggcatgcctcaccccacgttcccaatccacttcccctcctgacttcccatttaggagtcaataggatgatattctatcattagctgaggcttcagggccagggttatgtcagacctgccctggctgggcctgggtctcgcaagctgcccagatgatcccagggtccccaatgggggtagcttagtaaataccacaattcagagatgtctcaaattgtggaagggaaaattaactcagtggctgtatatcaaaaggcaagtggccattcatcaataaaaggcattagttacttagcctttcaagaaaaacgagccaccaatacctacaagagagaagcctaagaacaaataacctctaagtccaaatggggcacttcatcatccagcttttccctctacctgtagatttctgattggcctctctaccacttttattgcctcaactcaaacttattttcatgtgatggagagtcaaggcttcagggtttcagggccatgtgtctattactttactgtttactgagagataacagctgaaagaactcttgcatttttagaattggatttctttttttgttttttctttcataacagcaggcttctgctctgtttggctctatctggttgtgtctggtcatgctctgtcctctgcagtaacttccctgctttagttctccttctcctttccggagccagtcccttccagcttctcctctggttattctagtggagccccatgatgtctgttccagctgtttataattacctccctcaggctgcttggggtgagtgactcagcactctgccttgttttttgtttctttcctttttttttttttttttttaagaagccagatatttgtttaacatagtccatccaatatcacagccactaaatgctcatttctggttcccagatctaaacagcacctacagttctcaagtcactttgtataaataggttagattttgaaagtagaagtaactggacctgaattccacctccagccttttgtgcctgtctcttagcctctctgagtctgttttctcatctctaaataggggccatggcatgtgttcacaaagttattttggagataaagtgagacaatgaacagaaaaggccgaatgcagtgctcacccactatttttttttctccaaacataagcatattatttctcttttgtttcagatatccacttaaaaattacatcttataacttattccttctaatcgcctcttgtatgctcccacttctcttccatttctattactttactcctattaaatcaaggtcataatgcttatttctgaacatgtgcagtaatgcccaagtggttttttagcttctgatctttgactttttgacatcaaattaatcttctaaattgtacattcttttcttttctttttttttagacagagtctcactctgtcacccaggctgaagtgcagtggcacgatctcggctcactgcaacctctgcctgccagttcaagcaattctcccacctcagcctcccaaatagctgggactacaggcatgcaccgccaccacacctggctcagtttttgtattttttgttagagatggattttcgccatgttggccagactggtctcaaactcctgacctcaagtaatctgcccgccttggcctcccaaagtgctaggattacaggcatgaaccaccaccacaccgggcttaattgtacattctatccctgctccactatcagtacctagccttccctggttgctttcagctgcaggtctgagttttgcccctgtggattcaacactaccttccctgtcctctgtgcgagttttgacaaacgcaggggatctcctcagatttatccatttggcagataattaactatctatcacccactaagtgccaattgctgttaaggatcttgaggtcagacatgagtaagacacaacatatttcctcaacataaggttgcctcatggctaagcacatctaagtcactctggcaaaaactctccattgccacgaagactttactccatgtccatcctaaacaaaccagtctcagcctcaccagacagtgagctctcaaatgaattttgcactcctaggccttgcttttactgctacagcatgcctttattcattcggcagataattaactattacctactaagtgccaattgctgttaaggatcttgaggtcagacacgaataagacacaacatatatcctttaaagaattataagatcacgccaggcacggtggctcatgcttgtaatcccaggactttgagaggctgaggcaggcagatcacctgaggtcaggagttcaagaccagcctggccaacatggcaaaaacccatctctactaaaaaatacaaaaattagccaggcgtggtagtgggcacctgtaatcccagctactagggaggctgaggcagaaagaattgcttcaacccgggaggcggaggttgcagtgagccaagattatgccactgcactccatcactccagcctgggtgacagagtgagactccgtctgaaaaaaaaaaagaaaagaaaagaaacaaaaaaaagaattataacgtcagtgggagaaataaattccttgataagagctaggatgacgagatatacaagttcttgtgcttcttctgccagttagaagaatcttcctaattctcactcattctttcattcaagtgattttttttgtattttgttgttgttgttgttgttttgttttttgtttcttttgagcacctcagataatataggcattgaggatgtagtaataaaaacacaaacatggtcttcattttcacagagcttacagtctagtgggatataaagataacacatgattaaatatgtaattgcaacttgtgagaagttaattcatcaattcgacagatatttattgagtgccaacaatgtcccaggcactgttctaaatactgtatatacagtaacaaagctacagacctttcctgacttcatagatcttctacacagcaatcaagaaacaagataaaaaggtaacacatattacaggttactggtaaatgctaaggagaaaaaacataaaacaggaaatagggataataaaacatcatggggagaaaggggtttttacattttgaatgaggtggtcaaggaatgcctcccacgtaaatgacttttgaaagagaaccttgaaggagtgaaggagcaaggcatgaggatatctgggaaaagagcagtcccggaaaagggagtggcaagtggaaaggtatggaagtgggagtctatctgggtaaagaaaaatacagcccagtaacaaagaagagcaaggggtgtctactgcagtgttcagccaaggcctctgtaaagatacacccttaatctgaggtgtaaaggctgaggcaggtgtccacctgggttatatgagtgtgtgctccattttggatttctttttctcactccagatgcttccagaggctaaaacttatttctgagaaccagcccactccaatgacagccggccccttccagctgcctccttccaggggcctccaacctgcaccctgctccaaattaggatgataccccattgttatcacagcttggagattcctgatatctctgctcacactcccactcccacaatgccccactacagggatgagactaagctggaacctcttggaattctctacatccatttggacaactggaacccctccctctaccaacagccagttttccaactgggcaagtttcctccatatttatctcagtgcctcttcctcttccagaagcctcctgtccctgaggtcccagcatgccttgcagctagtcatggccaagttctgacatgttcacacttccccgaaaaagaaaaaatcagcagtatagcttctggagacttgattatttatggggcttcagtctacttggaaagcctacaaagaaaaacgacaaaggaatttgagttgtgatgagttatgttcaattctcctttgccatttactagctgtaagtctccaggaaagttaacttcactgagcttcagttttctcatttgtaaactgggaattcctttcctaccttaaagcttttgaaagaatcaataaaataaattaattgaagtacccgaaacataagtgtcccaatgaacgtttgttaaatctgaaacttccatgtcctctttggtttatgccaagtgccagcaaactactgtgtataggctgaatccaacccatggcttgtttttcataaacaaagctttattggaacatggccacaccattaatgtacatattgtcaaaaaatgctgattgccacagcagcagagttgagtagttgccacagagaccatatggcctcaaagcctaaaatatttactatcttgcactgtatagagaagatatgcaaatccctagtttataccatcatgggacactagaatattgtggttgagtgcaggagctggagtcaggcttcctgagtttagatgcacttttaccacttactaactatggaattcagagcaagttatttgatttatctatacctttgttttcacttctgtaaaaagggaatactagtttcttacattaagttgatgaaataattaaatgagccaatctagtgaagcatccagcacactgttaggcaaatggttagggttaatcaatataatggttattattgtgaatattatataatgttattacatatgctatccaagcactctctccattaactgggactatggatggcttttaaaatcaacctgaaaaccaaggttcctgactaaaatggcatttggcatataaacatccctccaaggatgtttatatgccaaggatcagggctcaaggatctgaacccaccttcatctacttttccttatggccacatccctccttctacttcctccctagaacctgcttggtaatgtggcctgaagattcaggctctctagatgagactttctctgtaatgcccttggcaggtgtgggcatgagtcaccgctgagcccagaccttttgctagtgaggatgcacctcccttcaatcatcattggcatgcactgcacaccttactgggccttgacattgaccagactgaaggaaggaggagcaacctctagtgactcctgtgagcagctgaggacttgttgagcagaacttacagcttaaagttaagggctaaagtgatagcccaggtggaaagaagaactaggtcagggcaggcaaggacagatgccctaatgtcttgggtgaggccacctcctggaaactagaaacccgagtgttgggtgcccaaatgttaaaacacaagagctcccgttaaataactctgactagacagatgtgagtcaataggtcaaaaaggatcaagagccatagagttgaatatactcagagccacttggcaagcaagaaaaaaaaaaagaaggctgtccaaggagaccttgtgtgtgtgcgcgcgtgcgcacatgtgtataaatatctatactctatagccagtgagggataagacagagcaacaacgcagcatgagtatgtttgattcctctacaatgcaagatttctaacatttataaaacagttgactctcattttccttttttaatgacacaatttcttaagtcaacataacctgacaaaatatgttcaactttggacgtgcataaaaagtcttacaaagttatacattcaatcaaacagatttacgtaccatttttaaggacaaaatagcagactcacgatatcaggttagccccagatcttctgagactcatgattcccctatcaataggacatacactttgaagcagctatcagtaatttttaaagaagacttcccatgtgaatcaaagggggttgattcagagccaagccacctgtagggagtgtagcacaagctgccaccacctcaccctgaatggataaagatattcatgcttcaaatctagggccccagcacacgccccaggtgtggcaatattgaggcgcaatagtcctgtcaaggaatgcaggtgactgttaaattggtttgctggagccaagaaattgtctttagcaaatgaggacacctccttgaaaaataaagacctcagccaaaagtgccaggaactctcttgctcccaaagtaaggtaattttctatcttaaatagccagtcctggccccagtgaactttgcaagcaggtaactagagcattctctaagaaaaaaaaaaattatttctcacactgacatgttctttctttcactttattatcattccaggtacagaactgagtataggggcaaatgagtctaaatgaaggaactttctagtccccaaacagggtgtggtatataataggctccccataaatttgcagaggctttctgattgactgtgttccactttgggcaaataaaccgaagccatttgttctctgcctgatgctacctctgcacactgttgtttcaagcatgtttctaaaatgttctctttgctgacaagaattgaatacatcaaaatgtaataacattctcgtagatatttcttttttgatgctttctaaacaaattacccattccaacatagagattaattagaaatatgctttcatttcagcttgtccgtgtgtctgtctgtctgacaggctagtagcatctttgcatcataccagccaaatccacaataaatctagtcatgcccaaaggtgggtttcaatgtgttcaggagcttgagctaggaaactcaggatgagcataatggaaggtggaaatactatggataatttagcaaacattttgggaaaacatcagattttccacaagtgtgggattcatcagcgttagagaaggaatgctgggtgcatcttcgcacatccacaatgcacacaatttgagactggcacttgccttctcttagcccatcaggctctgcaaacacacaggctgcagagagaggagagaatgtacaacctaaaaggagcttctcttcttttctcttgaaggcatttaaccccttggcacttcagagattttctgctttaggcctgaagctaaagatgaggataggttatgttgctgaacaaaatgagaaattcttctccccgagacagaaaggtgggctggaccgccttttgaggtttggtggtagttgctttgaggagatgctatctgaaagatcaactgcgcaagggttgatctatgaggcacatgaccgcagtgcttgcctgcctgaacaacatggtccctgcccagtttcttcttataggtgagtcaaatagattgctccaaattttgccatttgggagtaactgcatttatgactgatcgtgtcccccgaacaaagtcactgaggcaaacccagccccacagcatatctgccctggttataagcatttccctaccacctattgtaagctcagagcagtgctgggtgatttcacagggagccaccaaatatttcgagttctttatcttgatcctcctggcagcctttcacacaggtactgcagggaggtccttactaagtccagagctaggtgctggggatacagagatgagcaaaaaccaaggtgaagggctcagaatccagttaggggaatggacactcaccccaaaatcacatcaactaatgtgctattccacaatgactcaagtgcttggagggggaggaccagggtcctaggcaagttctgggaagcatagcacagtggttaaggttagagacatctgcccagagtccaatctcagctctgcctgctttgctatgagatctcagccaaatcgtttggtatctctgtgctttatgtgtaaaacaagactcctaatagcacctgcatcatgcggtcagtataggagtaagtgagatatttgcaaaacgcctagaatagtgcaatgtacgtatgcagctaaggaacatgcagctatggagatctgtgagggacaaaccattattcttattttggtgatgagaaactgaagttcaggtagatgatctgactaccccaaggtcatatactctgtgtacctgggcggctacctctgctgccccccaaatctggcaatccactccttcaccatgctgcctcctgtcttggcaaaggagcatgtcagggagccccagcctcgggcagggctcagctatcaccaccacagaagcagcctcactatcataacacatctctgtttaagaaacataaaccaccctttggcagcttctcaagtacatgtcagagccattaaagagctccctcccctcaccccacttttctgctttgactgtaagacctagccttacagggaaacacacaagagcttacccaacaggtttccccaacaaccatgccagagcaggcaggccccaaggagcccaggtctgggagggcccaccctcctggctgccaatgccccctctgacccgggcgccggcggcctccctctcctcctgtctgaacctgctgcctgggaagggctgatgtcactaatcttgcccttgtagctgcaggccatctcaggctcccaaacgcgattacccacaccaccagcttcacgcaggccctgcctccttccccctggcacctctccagctgtggctgagagcccagcttggtaaagggatggcctggcccagtggtgagtgtcccggccgggcaacttggcgcaagcctgacaagtagcatctgtgcttgtggaacctagcagcaagagctgggccaaagagctgagttccaaagctgggcctgcagaggacagaagagactctggaaatgagatgacaggatcagaacaggtcacaaatcttcagggagttattctaagaagaaatcacacccagttcccaaactgagtgtaaatgactcctcggaaaaccattaacggtgcccacctttccatttctcattagtagcctccttgcatcctggactatattggggacatatcatgttcacattctccactgatgggagctgaggccatactcagaatttcccaagggctcctgaggacagtaaaggtggtgagaaggcaggtgtttggctcagagttggcagaacaagcagggactccagagggcaatcagatttagtgcaataaaaaaaaaaaaaacattaaaatgaaagcagtaacaatagctcacatttgtcaagctcccactctatctcaggatctatgcaaaatactttatgcacatgagctcactgaaacctcacaaccactgggaaggtggatgttgatatttttcatcttacagatgaggaaacctgaatctaatggagaagaaattacttggctgaagctattcagatgctaagtggctgacctgaaattcaaaacctggtatgcctgaccccaggacagacccttccatgaataataggggccaggggtctctctgctcctcctcatgagctattgtgtcatggttttacaaacagcagaaactcatctttttgcttctaatccacctggatctctgatgctttaagtccaataccagataggtaagtttgacacatctttgggggttgcaactgaccaaatactagtcattgaccaggtaatgggcagcttagaagctctggagtcagatgtgaaaatgtttcccaactatgcaattaatagtctgggtgaacttgcttgtgttcatatacttctttgagccaaaggcttcttatctataaaccaggactaattatcattacattaataagcagggaagaggtggaggaaaaatggagtagacatttgaaatacaatggcagactagattgcaaactctagggaggcaggaagcaattacatcttgtccctgctgtacttagagcatccagttccctgcctgctagacactttgttcaataaattcttttgaagaatccattttacaaaattacttgcaagtttatgcaaatagacacattggttacatgtactaccaataagaaacaatccatatgaccatggatggagcatagctaaacaaacgtgagttatttcatgaaatcgaatgtgagatagtcatgaaaaggagcgagagaactctatctgtaatcatgtagagaggcaagcaggtatataaatagagtgaggggattgcagaacaatttgcatttatggcaaagtgcctaaaagagggtcaagagaagaatccatactagtctactaaaagtggttacttccacttgaaattaaaatttcaagaaggaatggtaagtggagaaggcggtgtggttgctggtgtaggaatatatttactttttgccctgtgcacttttgcattttttaatttgttttgacaacgaatctgatattttttgttacacaaaaatgcagtcaaaattattcactcattttaaataagtgaatagaagaataaacatctcgaatgccaaacataaaataggccccacaaatgttcatctttttctctcccttcccctaaagaatatttatcatgtatctgcatctctatgaccacaataagacattcaaacatatgcaaaatcttgctaaaattggttttgcccatcagtgtgtgtggccctgcaaaatctgatggcacccagctttgtggagtttcctggctatgtcttaaaaggacacatgacagacagcacagccatgggtttgctccaaaacagaaacagaaacttggatgctttgacaaaatttgaaaagggatgggtgggctcctgggatatctagcttagaaataattctcatcggaggctctgccatgacctcagtgccaaggaatattcattatcatggacctagtgtcttaccaaagagtcataactctaaattagaaaaccttaaggcccaagagaaaagtgaagaagggcagagtggtaagacaggatcatttccagagccagtgaacagtcattcaacatagccaggtccccttccaaaggaacacgcccttggttgactgcatttgtgtatctaattatcgagagaagtgggcaacttttgttttgagtccctactatctagacccagccatttccaaacagaccttgaacgtggtggaggggcagagaaagagcagaaaggtcagaaacaaacatttaggaaacacttactttgtttctggaaccactctagctgtctaacaaagaaggtctcctaggacttcgaaataccttaggaggtaaattagattacccccatgtcacaggtggcttagagaggttaagtgatgatcccacagggatttaatagcagagcctggaagaaaatttaggtttgtttgactccaaagcccatcttcacccaatacaacatacccaaagcaagggaacacacatacacaaacacacaactctttttttcactgtaactacttatacaactggactagattatagagggtgatgttttcttcccaatgtttcatactctctgggaagagtaaaagacacattggacagagcaagaatgtcacactgtcatacatcatgctgatattcacttcttagaaaatacttttgatattgtatatgaagtctcataaatattcattttcctaatctccttataccaatagatggtactgtttaactctctgtggagagctgtgaggcagacattggcaagggatgaatccccaatctctgctcctccccaaaagttgacagcctggtaggatggatatttgggttgcttttattttgtggtgaaatattgcagtaactattcctgctttgcttcttcttaggtactgtaggagtttaaaagttcctgaaagagcatcagctcaaacacatcaacttacaaatgaagaaaatgcagacagagaaacgaagttctttcttaatattacatagtaagtcagtggaagatcctggagtaacttatgctccatggctccctgactccaggtagtcaaatgtcttgacaaacagggaagcctactccatgtgttttgttaacagatttattgacttcaatgtataatttacataatattgaattcacttgttttaagtgtacagttaaatgactctttgtaaatttataaaattgtacaatcattgccaccatctaattttagaacctttccatcaccctagaaaacacaccttgagcccacttgtaaacagcccctgatcccacccctacccccagaaagctgcaatctactttttgtctctatagatttgcattttctggatatttccatatgtagactcatacaatatatggtattatgtgtttgtttctttttcacgtagcataatgttttaaggttcatccatgttgttatgtgtatccatactccacttctttttattggcaaattgttttctataacatggatatatcccattttgtttacccatttactatttaatggatatttgagttgttttcactttttggcatactgggttttaacccacatgcctaccccaaatgactgatcgtggctgctatgtatatgaaggattttgtggctatatctagactcaatgggaagagtgcccttgatgattagttatttctgtcagtggagagggaacagaaaatgtgggcatgcatacaaagtatcattacactgtttccaaaggggtctcttcttgttttaaataaagtagtcacatttctctcatgaaaagagttaaaagaaggcaagtcactgcaattgggaagaatcatgctcatttttggtgatgagcataccttttacatacaatttactactgcacaatcagtggctggggcttctttagcatatttttctggaaaggcaatggagccacatggtcatggctccttcaggccagtttctcactgggctcaggattaacaccatttatgtggccaagggttggtgaactcaaccgcagatagccccaagtgactgatgagttagcattcctggtgatcttgtcaacagccaagttgggtcttttttaatttttttattctgtttttttttttttaagtaaaactaggaagatatattatttccagttttcccttggggatggaagtatagacttaactatttcaaaactcagtgggcttggtggtgtctttgtattgtcatttataagaaaagagatgggaatttgagtgggcctgttggaagaatgaggaaattgtggtttatgtaaatacatcccaagcaaaaaatccagtattactttaggataatataaagaaaacactgttgtcagggggaaaaatagatagaaaaagaaaaagtattagaggataaagaagaagaggaagaaggcagaaattgataaaggataaaataaattgcaaataacgcattggttgtttgttagtcaaactcagcctacaaccatgttgtaattgttccacatctttttgcaaaagaaaatgaattggttccaacacttaaaaaaatcaggacacattatgtacatttctaagtgccctatgtgctttgaaaaaagaaagaaagtagatgacaggttgatgcgtgcagcaaaccaccatagcacgtgtacatctatgtaacaaacctgcacattctgcacatgtaccccagaacttaaagtataataagaagaagaaaaaagaaagaaagtctggtaaacatttgctataatagagtaatagctgttccctgtgaatggggcaaaaacgtaggtttattgcggcaccgttaacaatagcaaagacttggaaccaacccaaatgcccagcaatgatagactggataaagaaaatgtggcacatatacaccatggaatactatgcagccataagaaggatgagttcatgtcccttacagggacacggatgactctgaaagccatcattctcagcaaactaacacaagaacagaaaaccaaacacaacctgttctcactctaaagtgggagttgaccaagaagaacacatggatgcagggaggggaacatcacacactggggcctgtcaaggggtagggggctaggggagggatagcattaggagaaatacctaaagtagatgtcgggttggtgggtgcagcaaaccaccatggcacgtgtatacctttgtaacaaacctgcacgttttgcacatgtaccccagagcttaaagtataatttaaaaaaaagaagaaaagaaagaaagtctggtaaacatttgctataacagaataacagcggctccctgtggatggggcaagaatgctccagttggccggagtcttcactataccctactgtttacattcagtagcttcacacgtttatgtgactctgcatctgcaacatctgaaacaactgtgtccatattgactcccagccatcctgccgggaccttgggttatcaccacatttttcagagggtaaagtaaatgttgtaggggttaactgacgtgcccaaggtcaccatcagtaagagtcaaagctacttctcatttccagatatctgctgctttttgcagtctgtcatcttgctttgataggtagagaaaagaattgattaaatataaagcaaagaatggagtaaaaaacaaaggaaaaaaactgaggaagagggagtgatgggagcttttaaaataaccgtttattacttggttgaaaattaagctaaagcatggactctgccaatgaagggccaaacacaagttggttggacacatatattctttccccaggtcctagaaacaagtccacgcatcctaggcagaaaacattgttttcctgactcacagagacaactctgaaaagcatctgagagttggtttaggaataaaatcacctgtttaaattaactaacattttctaaatatttatttaggaaataatattaatatacctatcactcacaacttgataatattacctatcactcccaaacttcagtggattagcaagctccccaggcagttccagaaatgcagtttaggccagagttactatctggtggtatagcccctctctaaatcagtctctggaacaggcctgaccactgtattctgtcagaatttattgaggcagcataagaccttgtttctcacttctttggcccttggcaaaagaacctgagatctcccctgagagtcaccacgtgtacagaaatagaggagagcagagaaaacaagcatttctttttgcaacttcacaatctatttctggggttgaacagaagccattaaaacattcccatgactctgtgccaagcccccaaattactaatgacagacatgctggctcaaagggagtcactgctggcaaatatccctctggtatcttgttaacagtaataaccctgagcctttcattgaaagatctcaaagcacagtgcaagccttaattgactctcccctcaactctgtccctgaaaaaggtaattatcattatattcctcagacagtttacacaggggttaaatgggcgacggaggttgaatgatttatccttgtttcatattccgagttgaaaggaaaagtctaaataatgtcataacttggggtgaactcagctgtatgacttgctggaaccagtgggatagcagaaacagagagaacgagagcctggtgaggctgatgcaacgagagaggccacaggccaagcactgtgtgcagaggtgctgacctggagttattttagcctaaggacattatccataactgcccagtgcaggccagaaggaacagagaatctaagccagagtcctggaagtgggagaccctcaatatcacgtacctagagtctaaagccagagtccatgctcagtgatttagacaaaaatcagtctctatttctctggtgtgcagtgtaccaagagttggaagtgtacctggaccccaaacagataagaggttcatctcagtggagaacttgcatgctgggcatggcatctgggacagtcccccagtcctaggaactgcaccatcatgaagatgagcaccactgatctcacaaaccaattcctcctactacaaattctcaccttagtaaacagggcctctccttacttaagagccataaccaaagtgcagggagtcatcaactccatttatatttgatacccaagttcagatgacacaattatcttccaaaccaggcttcttatcaccacccctaccaccattgactcatttgaaacctcattatatctcccctggattattttaacagcctcctggctgttcctgttgctttcagacttttcccaagccaaacaatcgggactgtccaaaggatatgagactgtccaaaggatattcctggaatgcaaatgtaagcatggcatttataaactcccctgataaaattcttcaagttcccttccacagggaaaagtgtaaaattcaaaaatcagggtgaaattatgtttccgataaataatgctgaaataattcatcaccagcagatttgcactataagacatattaaaggctgttcttccagcagaaggaaaattatgccagctgagaacttagctctacatcataggcatgagaaacattagaaatggtatatataagtgagtatatataaaacactatttttctcatttttatttcttcaaaagacaaatgtttgaagcaagaataatgctatttataacataggcatgaatcaaattgaatggtaacaaaagatggaaggggataaatgaaagcatataatgtatataatataagagtcttacattattcatgaagtgagatgatatcatttaaaggtaggctgaagttagttaaaggtgtgtgttatattccctagggcaatactaaaaactaaagcaagggctagctaataagccagtagtggaaataatagaacactaaaacaataattgacaaaaacggatgcagaaaagaagacaattaaaaaaatgaatagcaagattgtagatttaaacttactataccaataactacattaaatattactaatcttgacactccaattaaaagacagactgtcagagaggataaaaaggcaatacccaaatataggccaactgtagaaagccctctttaaagtcatagtgtggttacaagttaaaggatacaaaattaaataccatgcaaacaaacactagacacagactagaatgtctatattaatatcatacaatgtagacatcaggataagcaatattatgaaataatatgaagaattttataatgaaaaattagaaagtacatccagaagatataacattttcaatctgtatacaaacctaataacagagcttcaacaatgcctgaaaccaaagttgatagaactgaaaagacagtgagacaaattcataattatagttaaaagacttcaacattgctcactcagtaattattagaacaagtcagcaggtaattattagaacaagtagtaaaggtatagatgactttgataacgttaaaaaccaacttgacctaagtgaaatgtttagaatagtccactcaacatgataatatgcattcttttcaggtgcacagggaagactatatggtgttatattatattataagctataaaagaagtatcaataaatccaaaaaatctgaaattattcagagtatcttctctgaaaaaattaaattaaattataaccaagaatacaaatattctatgtgaaaacatctcctaaatttgcaaactgaacaacacacatctatatagactgtgaattaaagaataaatcacaagaaaaattagaaaatattttgaactgaaatataatgatatcagaaaatattaaagcaattgtggaaaggagctaaatcagcatgtagctggaaatgtatactatattataaagtgcttatgttaggaaacaaaaatcgtataaaatgagtgacctgagctttcatttaaataatctataaaaaagagcaagctaaacctgaagggaatagaagtaagaaagtaatgagaggaagccaatgaaataaaaattagacaaacaaaacagaaaaatcaatgaaactgaagctgtctctgtagaaatacaaataaaatttataaactcttaaatagactaatagcattttttaaaaagaagaaacaattccaataatttaaggtaaatggggacatcactacaaatccacagaaattttaaagagtaataaataagggtcaataataaacaaaattatgctaacaaatttgacaacttagctcaaatgaataaattctttgaaagatacagattatcaatattgactcaagaagaaatagaaaacttggatagtcccatatcaatttttaaaataaatccttaattagaaacatccacacaaagaaaactccaagccaagaggacttcattggtgaattccaatacatatttataaaataaataacaattctacgcaaactctttcaaaaagagagtatggaggaagatttctctaatcatttcatgaggactcttttacccttacccaaaaccagacaaaatattacaagaaaagcatactttagactgatattttttatgaaaaaaacacagaaaaatccttaatctttagtaaattataatcatctagatataaaaaggtagtatattataaaaaatagatttcagactttcatgactggcttaacatttgaaaatttactgtatgatcagaataaagaataaaaaatctagtcacgtttcagtataaacacatattcatatgtgtgacaaaatttaactcttttttatgattaaaaaatcttataaaactagaaatagaagaaaattgccacaatattatacagattacctatgaaatagctgcagataatatcataattaataatgaaagactgaattcttattctctaagttctggaataaggaaagatgtcagttctcaccacttctatttaatactgttactgaagtcaaataaaagtcatacagtctacaaaaaattaaagctgcccttatttgcagacaacatgatcatgtaaatacaatgtcctaaaaaaacaaaaaaaaaagttattagaactaacaagttaattttaaaagattgcagaatacaagttcaacattcagaaatcaatttaaatctatacatcacaaagaaacaattgaaaaataaaattaaaaatacaataccctttatgctatcatctcaaaatataaaactcttaggacaaatttaacaaaatatgtacaagacctctaaacataaaactgcaatgcaatgctgagagaaattaaaggtctaaataaattgagagatataccatgtccatggattggtagactcaatactgttaatggcaattctcccataattggtctacattcaacaccatcccaatcaaaattctggcaggctatttgtgtagaaattgacaaaatacaccctttaatataatgaattttattttttgtgagttatgcaacaataaagttgatttttgtaaaaataatatatatttatacagtatattatgttataacatatattattatattatatgtaataatatatattattatataatatgtaataatatatattattacatattatataatatgttataatatatattattgtgtattatattatatataatgtatattattatatattatattatattatatataatgtatattattatatattatataatatatattattgtatattatattatatataatgtatattattatatattaataatatgtattattatatattatattatatctaatatatattattatatattatattgtatctaatatatattattatataatatataatatatattattatatattatataatatataaatatatattatatacaatgtataatatattatattataatatatattatattatatattatatatatttatctattatatatatataacagtaacaactacaaaagtaaatccattaagaagttagaataacctcttctggaagagaagaaaggtcagaaaaacattatgaattcaaaaatttacctaaaataaactaaacttgaaaacagaaataatgagtcacctgggttagcaaaactgcattccctgctactaggtagaagagagagctaatgagctaagctaatttcagtactaaaaaaattactggaaaagttacatttttgcatgcatgagtattttgcctatgaaacatgatctctcatcccttgttaatgaggaggatatctattcctcccacttcaggcatgaatatcactatgctattggaagacttggtccccaagattgcttgaatgactatgtaaggaattggagactagagccaagattaaattccgatattaaacccagtgcttcaaaggacctaaaagagcatttgtgcctctgaactgtacaaaatttctgagaaagaatctggtagccttcagtaaaacaggcaggagctttctgttttagaagccctctctattttcagcatgctttctgatggtttctccatacttgcagtgctgagaaatgagcatatacatcaaactttgctgtgcctacatcaaacatagggactttcagcttctttgatcttgatactatttataatttgttttgtctgaattttaggagcactttaaacagttacattgctgtgtatggaattagatatctctttctgctgcaaggtaggtaaaatgcaccatattatcatgaatgcagggctgtatacttctactcatgaactctcaaggtgtttgttttaatctcttcttcttgactgacaagatcatgtgtttaatatgaattgttacacaatatcttagtgacatctgattgtttttttccacacttggagagaggcagcctctaactttgaaggaatatcagcaggtaaacacgagaacattacttgaaagcatgagacaaagcttcaaagcttcaatgcttcagggtgcctagggaacagtaagcaaccacacaataagtattactgaattccaagataagaaggcttgtggaacacctgaaaaaataggtaaggattcctgaaggaaagtgcaccacagattatttcagcagctgcatcatccagaacttgagcaatattttcttatgttcagtcttcaggatgagcaaaacacagcttccaaactcactctaagcaagtctcagacggaagatgataggaaggaggtgatctttggtaacataatcaagttgctcaacttggtgctggtgaagcctctttcaagatggttcacttatacggctggaagttgatcatgactgttggctcagagctcagccaaggcttatagatcagtgggcattgactcctctccacgtgagcctctccacagttgtttaggcttcatcacagtatgttggctgggttctaaaagacagcaaccctcaaaaaacaaaattaaaatgcatggcagtcttttgatctaacctccaaaatcatatagtatcatttctactggactctcttggttgaagcagtcgggaagacccacccaaattcaagaacagacacagacaccacctcttgatgggggcagagtttaatattccagaagaggctgtgatatggaaaatacagttgcactcatctttggaagataatctgccagatcaaataactttgagaactattctccatttctccacttctctatgcactctattgtatgatttcttttttacacatggaaagtaatactgtacaccattatgcacacatgaataatgtaatggaaaaagtaaaagaatatcctctctgaccttgattacaaaagcattttatttttaatttttgttacttgttttttgcttaatactctcattgtatagtcaaaggttttataaacatcaattctcatcatggatgggataaaataagtgacaacatcactttactttacttaccaatggcagatagttctatctgaacccaaatctttcctctaaattattctcaacatatttttccataaaatcaccactaatcattgatggttagcatatgtgaaaaaatgattttgccatcctagtacagtttgataatgtagctgcctggaccaagatgttaaaagcaggggaaaatctgaacctagatgggggaaggaggtagtaagaacttaaaataatatgtggaaacaaaatgaatcactacattacccccaaatagttggtgagagaagagccaggctataatatgacaggttcaattcagatttaagatgagattggggatatctgtggagacacaatgtgggaaaatctaggtgaggtatagttagggaacttaagggttgcgttataaggacaccaaattcagagtaagactgtgaccagaattctgctcaaacaggtgtagtactaacctcaaggatggattgatgagaaccaagcagtggtcagcactagccttctaaatgaagatcacaggcaggactctccttcaggggttcccatgtagggaaagagaaaccctgagcaggcgccttctcccggcagaacaggttctgtcctagctatcatgccaggtgtatataataatatccaaattcttctaatacctaggtaatgctgatattaggctctccctcttctgcgctagtgttttccgattgggtgtgcatgtcagactaatctagaaagcattaaaaacaaacacacacacagaagactgatttcatttagcttttggttgatctcacaagccgtcaacaaaatttgagtcaattgaagttagcattaaaatagaagaaatgttctaaataaccaaggataaatgaaacaaggaatatgcaggatgttcatgaagaaaagtcacatattgttgaccaaaataaatgaaattgcaaaagaacatgttcactctgacacattttgtacaaaagttttaaatatgcaaaacactatatatatagttatggacaaataagtatgctgtgaaattagaggttaaaaatgcacaaaacaacacaaaaaagacagtgcagcattattattattgttatactttaagttttgggatacatgtgcagaacgtgcaggtttgttacataggtatacatgtgccatggtggtttgctgacagtgcagcattttataatggtggttacttttgagagtagagggaaattctggtggaggaatgtgcctgtttctataaacttttagatgtcaatttaaaaatatttgaatatttgacacaaaaaacaacatgtcaacatttgatcactatgtctagttttaattttctctatgaaatagttattatttaagtgtaatcaataaacagaaaatgataatgatggagaaacgaagaagatgaagttgagaaggaaaggaagggaaggaaggagaagagaatgaaaaagagagagaagaatagaataagaaggaggagaaggagggaggggaggaggaagagaaaaaaaaggaagaaaggaatgaagtccccaaatattcgtaagaaaaaaaatgtttaattccacttggatctgtgttgaaaacttgacagcctgtttacgtttcatttagacaaaataaatgctgagaatgaccccagaatataaaataaataattaaaaaggtgaaatctaccctatcagatgtcaaatcatactatacagctatggtaattcaaacacagaacaaaaataagactacaaattatttaaagtgtggggaaggattattaaataaatatgacatggatgattggttaaatatacaggaattataacaaggcaaatgtctcctcccttacctcataaaatttacctaatttgatttaaattgatcaaaaattcaaatattaaagaagaagtagtaaaagaattgacaaaaaacaataatgcatctgattcatctcagggtagaggtgccctcattataaaagcaaagggagaatccataaaaaaaaaaatgttagggctgggcgctgtggctcaagcctgtaatcccagcattttgggaggcagaagtgggcgcatcacttgacatcaggagttgaagaccaccccggccaacatggtgaaactctgtctctagttaaaacacaaaaaaattagcgggtcatggtggcaggtgcctgtaatcccagctactcgtgaggttgaggcaggagaatcgcttgaacctggggggtgcgtaggttgcagtcactgccactgtactccagcctgagaaacggagtgagactctgtctcaaaaaaaaaagaaaagaaaaaaaagaaagaaaaagaaaatgtttgggaggttttaaaaattgtaatacctggttctgatgtgggtattgtgagatggatactttcttacaaacattttggcaacatggattaaaaccttaaatgataatattcccttcaagtcagtggttctatttctaagaatctaacctagtaaataataacaaatgcacacaaagatttaagtatatgtatattcattatatgattatttgcagtattccaaagtggttaacaattcatacacccaatgatagaaaatggagaagtactctccatacaatgctaactggcaaaaaggaaacataagaataacatggatctaatcacataaatagaatgtatgtagattgtgagtctctggaaattattcctgtttgtcattcttctttacagatgtatgtattctacaattaacatgaattattttatttttcattttaataaattatgttattaaattatgatatattgattttaagagtcaagaaatacataaagaaatgtaaatttactaaatgctttctttcatcccaccctcctatccccatgttccagaagtttatccgagtttattgtgtttactttcaaagacaactgtctttggatatgaacacatatctatgtttggaaacatcacatagatatgtgttcatgtgtacagtgtgtgtatacatatatgccatactaagacactaacgtaagcttcctgtgtgccagggcagtttttggtttggggaacatggtgattcacttatgatgatcccagccaatggttaatgtggacacaaacacagataattctgggaggcactaaaataaagttagaaagttagactcaggaacttaaagttggatttgatccttttttttctcatcagtgtatattttcttttctttttttgttttattttatttttttttaggttcagggtgtacatgtgcaggtttgttagatgggcatattatgtgatactgaggtttgggcttctaatgagaacgtgatcttttctaatgatgagatatgaggttggaggttgaaggtatagaaaggctttctggaggagccggcccttgatatggacactgaaaagagagatagactctccaggatacattaatctcaggtggagatagagaaaggctatttctgacagaaggaggagactaagttggggaagttgagcacaagatcaggcctgctgggcctggaaattatggaagatgttagtaaaagctaagacagtggaggttgtttcagggcacatcacaggggatctagacgtgcgatgtggattctgaatacctgtctttccacagtaggaggtctttgtggttttgagcaggacgatgctgctgctgacagagacaaggacagattgaagagggcaaccagaaggcagggagttaagtcagccagcttaattattaacgagatgaggaaggccagaactagagcatttttagtgtaaagggaggaaagggagagaaattcggagagatcatggagggcaacacagcagggttagaaagctaagctgtgcctgggatatctgactcccaggggtcatggtcaggaaggatggtaagaaagagggcttaccccttcttacatttcagacatatgttcaatgtaattcaaactttttaaaagacttcttgttgctttttaacttcccatgtcacgttctccatagtcacccaagtcaaagcctgaagaaaccaaagagacatttctaggagaagttgaaaaatggtgactggagtcacctccagtggcctccagctttggtgcattgactccttactagaaagatgtagggcttgctggaaaagcaataggtgtatcaacaggtcaaatgcccttgaccctgccaaagaaagaaggactgacaatgaaacccacatagatggggacatttcaagggcccatatttcctaagagtctttagcctgcatagggttccacttgccccttctgatctctgtatttttgcctggacttttctatggtggtggtcacagctgaagaggcgaatattactatattttgatcttggtaacacagtaattaattattttttttaatgacctgttaccatagagattaataagcaaaagctctaatactactagcctgccagggagttcacacatgtgaaatacttagaatagagtgacacagagaaagcacaccatatatattggctatggtttgtattcagattaatgaaaacatcacacttcagttctaaaggtgtctgtttcagcttctctaaccctccagcctagactcagtcctgtatttgccctgaaaacataggtaagcctggaatgactcttggtgtcataaacttgggatcccctgcacccattgtgggtctgtctgtggccactccagccatgattgtgaggtctggatgactcaggcctgctttgcactcagccaggcaccttttttagaactgaagccctattctgacctccagtccacttggcttgggccctgacacctgtctggccttaagaacctctctgcacacattgatgccattctctgaaccaggcagcctgacccgagcctgacctggcttgactgccactcctaggagaatttctgctgtcctcttctgcctcagatcagacccccttatattttatttccggactgactcaagtcatagtcaccatgctcctttctcgttattcaatacaagccctgtcccaccctgactgcctccctttcccagtgagcagatgcttttgaattcccagcctgatcgcattcaaagcgtgagatgggggatcttagaaatccaaactccccattctatggatgagaaaccgtggctcagagatgggaagtgcattcctccatcttacaccctgattgtaggacagacagaaggtaaaatcccagcccctgggaacatttgccttggaatattatcacaattccaaaaaggctatggcttgcttcctccacttgtccccaggtaacctccaagagagtttctttctgagacagtacttagcaagtaattccttcttacaaaagtagtcaaggtcctcagatttacaaaccccttctctccttctggcattccggggttgtcaggatattttggtctgtcagtaacctctggggctgaaacagaggaagagaaatcattggaatctttgaagcagaaacagcaacatcaaatgtttcctctatgtcctgtgagttggcaaaactgcaggtgtagaaccaaggtatccacatgattatttcaaatccccacatcttcttgactttttaacagagcctattaattgatacactgagataattgacacattagtaggagtctccctggccacttccagtgaactaagcaaacacatggaaagtctgacctagcaggtctgtggtccactgggacttgggagtccttcctattcccagcgtgctgctgagactattgggattacattcccagtctttggcatttccatacatgaacagattctgaatgaagccaaaatcaagtactagaggattaagtcccggaattgcaataattttgaattccatcccctccatctattgacacacggtttccaataagtcatacaacccagactgcagtgtccagctcttaaaattttaaaaacaaacaaaaacagaaaagcctctgtcttgctttatccatggaatttaaccatctagatagaagaccaagtacacaaaggtgctttgagcattgtaaaaatgtaacaaaaacattccacttcctttttaatatgccatgcaattctttcaaggatatcggaaaatagaggatgtaaaatgaggaggggtagttgacatacacagtctcaaatgttgcttcctcatctgtaaaatgggagcaagagcagtgccacttcataaggatgttttaagatctagaacataatgacaggcatatgatgacgattttaaatttgagtcgtgtttgcaaatgaaatccagaacattccctgctgctccagctgatcttgggaggcattccagtctctttactgctctcctgaaacagcgaggcaaggtccttccctggattctgcagtgttttaaagagaaatttcaaactttcccgggaggcttttctaaagggattatgtcaactgaagggaatgaacaggcaagaaacaagcagccatgccacttgacaagatgagggtggcttcctaccttcagctcattacacgtagcctgggagccccttcccagttcccatcacaccttcccatcagggaggccatctcgaaaccgtgaaatgctgctctcctccaaaggcatcaagtctcctcaaagtctgaaaccaaagtggaaggactaggaggctccttgccaagcctcctaagatcacattttctggctgagtatggcctcctcccagacatttaacattgggcgtgcctccctctttcagggaaggttgggcccacccacagggacatagatttaccaaagaggcataaatgaacaatgatcaacactctgcagcacagaacagagacacacacaatggaagagttggaaaaaaattgtttccctagagaagcactctatctatgcaaatagctaggaccactatccttctacctaggtattttttattttctctgcaagagacaaaagtggcagaaaatgcctccaaagaaagaaatcctaagcctcaagaaaaaagataaaagggaaggaagggtgttggaatacaaaagctggaaaaagaggttggcttttcaatttgggagtaaactatattcatggtccttaagagaggatggcctgtcagtgagaaacaggagactctgggaagacagaggcatgggagaaagatcgttccaaaatgtgtgagaatttcctctaacttcgttttcttctctccctagccagcctgcctcccggtatatgcatatatgtatgtatatgtctgtctgtctatgctaaggcaagatgaagggagaaaagccctcctgccatgggactttaccagcgtcctcgcatagcattcataataataaccccatcactcatcaaaagtgctctgcaggccaggcctcgccgggcctgggcaatgctctgatcccgcagccagctcaggctataattgcaaacaccctgcccccgggaagtgtcaggttatgtgaagacacttgggctttgctggtgtctgtaaaatgcaagttcaaggggactttttaacatcagaagcaaaaatatgagagtcaagagacaggtcccttgtgccctgcagaagatcacagtagagataagaagtgggaggcaattgctctgaaggtgggaaaaataatttgaaggcagcagaacagacacaaggtaattaccgctcagacacagcacaggcaaaaaggcccttgcttttagggaaacaagaagtgaacagaccaagccaggaggagaggcctggctcttatgagttgggtgaattgtcagtgtttacttcctgataggaaggcagggagagagagaaaatgaccccccaaaggccctctcaaacttaacaaatttgtgagccaagttaggtatgagtttttctcaacttttcgattcggttttggaaggacagtgtgcatgtgtaagtgtgcgtgtgtgtgtgtgtgcatgtgtaagtgtgtgtggtaagctggaaaggtcatgaaaacatgaaggaaaatggtacaagaaagagatatcaaaaatgctacctcctatctgattctaactttatgacattctggaaaaggtaaaactatggagagagtaaaagcatcagtagttgccagaggttcagggacagggagggaaggatgaatgggtgaagctcagaggatttttagaacggtgaaactcttctgtgtgatactgtaatgcagggtacacgtcattatacattgctcaaaatcctagaatgtacaacacagagtgaaccctaacataaagtatggacttcaattaataatgatatattaacattggctcatcaggccggcgccgtggctcatgcctgtgatcccagcacttcaggaagccgaggggggtggatcattgaagtcagaagtttgagaccagcctggccaacatggtgaaaccccatctctactaaaaatacaaaagttaaccaggcatggtggtgcacacctataatcccagctactcaaaaggctgaggtaggagaattgctttaacccaggaggcagaagttccagtgagccaagattggaccactgcactccagcctgggtgacagagcaaaactgtgtctccaaaaaaacaaacaaacaaacaaacaagcaaatatatatatatatataggctcattaattggaacaaaagtacccttgtaatgaagatgttgataatggagtactgtgtgtcacaggaaaatgggggactatgagagtggtctttattttccactcaaattttctgtaaacttaaacctgctctattaaaaatagtctattaatttaaataaaagagagagagaaaagatgtgtgtgtgaatgtgggatcaaacatttaaataatcccttaccatcccaataaaaagttgacagtttggtaatcagaggaaaattgggtattgtggcccaggaaagagcctcagagtaaaaatctagaagtacctggaattcaacttgggtgtagtttaatttcatcaaaatccaggaaaatagttgaagtcatcctaccccagcaaagagaaaatgaagcgtcttccccgtgcggctctgcagcagggcttcctggactctctgatggagggcggctttcatgttattgtcatttttttgttttcattccagtctattaccctactgatacgtttataaaataaaattgaaatgagtcacaagaaaagaatgacagtgcacttgggtattaaattcttgttgaggtcttcttacaaaggcttattctcataagtagcactgcactggaggagagtcactctactgaagaccctggcactgtccaaacccaacagttagcaaacacaaagaaatacaacaagggaatgcggtaagtatttcccaggaatgtttcttgtaaaacaagggcaccatctcttgtctgaacaattgttctgttccctagccttgctgtcttccaatgtactctcctacagccatcagagacatcattctaaaatacagatgtaactgtgccactttttggcctgacaccagatagttttttgggtatctcgggatgacctgcgcgttgtttagcaccttattcatagcaaactggcccctacttgcttcagtaccgggtgaaccaaggaaagtcccaactgggttctcaggctaagcaggaagactggggtttgacccaagtaatccccaagaattagcaccctagtccactaacatatactaccaggtgtgggcgggtaagccgaatttaaaaccactgagtcaagagtagtcacttagcaaattctcatagtcgggtggggatggtgagaagcatcttagaatgcccaccaaaagaatttcatttgggacaaaaggcattccatgtaaaggggccagaatgaacaatggcatggaagcaagggatagtgtggaatattcaggaaccctcaagacatcctatgcattttaggtagggaagagcctcacagcttcttttagtaaagagagtggcaatcattactaattactgcagaaatcctcaaagttgacattctctaagtacctgtcatgaagacatcctctacttgcctcaaattggcatatttggaatatgctttaattataagaacttgccagagactggggaaaatctatagaggaaagagaagtcaaatgttctgagttttaatgttcacatcaatccaatggtgtgggctttctccaattttacagatgaggagactgaagtctgagagaggacagtgatctcagacagtcacactgagtaagcagcataactgagtttccaactgaggtctacgtgccactaaaagctgtgcattttgtacaagttcaccactgtttatgcacgtaggtgtgtatggaaggtggttattgagaggagagaggagagtaagaggcaaagagttacacattttaatcctgtgttggcaaattatatatatatatatatatatatatatatatatatatatatatatataaattgaactagttaataaaaatttatttgtacagagtgttttttgtgtcaaacactaagtgctttgtatgtatcatccacttaattcctacggtaactcagtaagcttgatgtggcagattgtattatattattgtccccaattattcactgtcttctctgtaaaactatcatgtactcctgcccattgtttgtatgacttatggtgttgccctgtaggcagaatatactttcctaccctaatgatcagatgggccatgtgacttgcttgggccaatggcatgagaacagatgtgctgcttgccatgtcttaaagtttctcagctcatagcctgggtcttggaataagaaatcgcatggagcaggggcatagcagttgacctgcagctgagtgacaaatgaaagtcataagtcaatgagatactgggggtgtttgttactgcagccaggctgatggatacaaatgaggtattttacaaatgaggaactgaagttgggggagacatctttgcccaactcctaccacttgtaagtagtgtctggatttagatccatttctatttgacttaaaagtccatgccattttaattagaattcaaaaacctcctgcaaagtccaaattgtttaaagtagatcacatgaggtcacttcccagacaggaaataaagacactgcctctggagtctcggcatgttccatgtttcctgtggcttctccatccttccaagccctgagagattccagctcgaagcatccattttgttaccttaatgatttcttaaaagagaataaaatctctgaccctaccacctattcgaagcattctgtaacaacctaataatggggctccctccccccagttgtccccttagagacttatccacactacagttaggacaagtttttaaaaatgatcttgacactccctggcttaaaaccttttggtggcttctcactgctttcagaatcaaatcctaaatggcctgtctcttgccagcctcccctaatatatcttatagtgtgctgttccttgcttattatgtgccagacataataacacccttttagccaccaaatgggcctagctgtttttccccagctcatagcctttccacgtgggattccttctatcttgaccacccttccatctcctccctacagcctcaactcaaatgtcagaaatgatacttcatatagtgtttcccaaatccttttccataaccttcatctgggtcacccaaaaaaatgtattttcttgcctgcttaacattagatttgatcatgtgactaattctgggctaccgaaatgtaagtggaagtgaggtatatgcagccatccaggctgcaccatcctccagacccctcttcccctgcctcaggtcctcggcataccacttactttcatctctgctatgccactatctttgctttacttacgatatttgtcaccatctggaattatcttcttaattcattggtaccagatcattttccctctaccatgcagacttaaagctctaagaaggaagggcctttgtccatctgttcagttgcatcacagtgcccatcacagtggctacatataatagatgctcaattaatatttctgaaatacataaatatatgaggaaataaatgaatagagctcttgcaaaaatgagttaatttatgtaattagtacagtgcctgatagaaagtaagcactcagcaaatgtatctaattatgaagatgaagaattgaaacaaaaggtctttcctttcatttctgtgctatggaaaggaaggaacaaagatgaggttaggtcttgggaccaaaggtctacaaggggcagtctcagtcttgaatatagaggtggcctgggagaacagttactagggagtagacagtgagagtggactcagcttcacaagtcagaacttcttttcataacagcaacatgatgctggaattattagtaagggtctggtatgccagggccaggacatcataaaccttctgcatccacatcacagagcctcttataagaattgctccatacgtttggtagacatttactgggcttagactgtgggcaaaattttggctggattctgcaattaaaagataaataaattaccacccttgcccataacaaaccagagtgagaaacagacatggaaacaaataattaaatccaaaatatgactagtagtgtgatagcaggatggacaagaggatactggagtacagaaaaaaaaagagtgcctctgtcggtgcagtcaggaagacttcaagaggcaacttcacagatggaccttaaaaacaagtatgtttcccaagaagacacagtgggaagggcattctaggaagagggaacagtatatgtaaggcatggagtcattataaagtcttcacaaatcttggaaaaggtaggaagttctggtggtttaagcataaggtaagtacctctcacaagtatgggaatgtgtggttttgctttctccatttgaaagaaatgtgggaaatagacaataaaattatgcacaggaaaaaatgaatctactggtgaaaaataaaagatttactgattgtttttgaatatactgttttgttgtagtgtgttcattcaagctaataatagagataatttctggcatctaaactctttcaggttctttcttaaatgtattgctcaagcaatgttctactagtaaaaccgaaaactcaaagttagaaaagaatgacccagaataccaagaacctaataaccccgtgttcatattcccaaggcttcagtttgactgacccatccctttcccaggagactgaatgaatgaaaacaggacttgactgcattttaactatggtagaacactgcaggggcccctgaaggatatgtatggaatacctgtcctggagaacatcacctagaaatagattatgtataaacctgcctgaaagagagctggccattgtccactcttgaagttgtagatttccaggataaggagaatcagtatacatctctagttcatggattttttatcttggatccagacatataggaccctccttgtctgctgtggatggagtagggggtgtccatggaaagtgttttggaatccaggaatcacttgaaattgtatgccaaaatttttttttaagtagacatgtgcattttccagggaaagggtcctttgtttactggagagtttgtgtatgatttaagtttgaaagtttttctagttgttttctgttcattcgccagatcacatggaatcaacatgttttcaacttattgttctgaagcctgggaactgaacaagcctgactctcagttcttggcaaaggatagagcattttcctaggcagtctttcagaaaatcctgctatttctccttccaaaacacatctcaaatttgtcatgtgtctccatctccatcaccaagcccctggccaccaagcctccccatcatctctcaccagaacaaatgccaaagacttcaaataggtctcttttgttcaccctttccttgctgcaatctaattttcacatagcatcttgagtgacactttttaaaatgaacattatgtcaccaccacactgaaaattctccagtggtttttcatgttgccttcaatataatccaagtttctcagtatccaagggccctaaagccctagatgaccaatttcctttgcacttttacaacctcaggtgatgccaccttcctgtttgctcactagaatccagttaggctggacttacttctgctcctgatcttgcccagctatttcttaatcccaggcccacatccatggagttctaccttctggaatgttctcctttcttcatatgattagctccttgccatcacttaggtaagtctcaacttaaggatatctcctccatgaatctaatttttttttttttttgacagattctcactctttctcccacccaggcagtggcacaatcttggctcactgcaacctctgcctcctgggttcaagcaattatctctctcagactccagagtagctgggattacaggcacaggccaccaggcccagctaatttttgtatttttagtagagatggggttacaccatcttggccagactggtcttgaactcctgaccttgtgatccacccgtctcggcctcccaaagtgctgggattacaggagtgagccaccatgcccggccagatagatctttactgaccatcctatcttggtagtttctcattcttatcacatttaatttttctaattataaaatcctattcatttatcacaacagttttttagaatgcattttatgattgtttattttttatctgtattctctactagataataacttttcttcttcacagtcacatgtccagaccatgatacaacacctgccacacagtaggttgaatggttggataaacagggtaatagatcaatgaatgaatgaatgaatgaatgaatgaatgaatgaatgaacaaatgcataaatggatgaatgaaaaaataaaaaagaaggcctgtaggcagtcttcaggctccatctttctgtgtagaactaatgccaccacccaggtgtgctaggctgtcagatatgcgaggatagcaatggtggccaacagggatatgagttagaaagagttgagaagggcatgctaaggacaattaatggttgcttgttagagggtgtggcctgcagtccaaaacaccctattctcaagggcttgatgtgcctaagtttaatttgaggcaacggctgtatcttggactatagtaagggaggcaggggaggggaggaggattttcagactgaatatagtgcactaacgggctaaaaggaaaatttggaaggtcttcagggacgtttccttgatcaaggaaacctgagagtagttttagatgagcaagagaagggttgggatggaggtgagaggtgacgattatctgatattcaaccaaagctcaaaacaaatggctcagggatgggtgggagagatggtcaccttgtcctcttcctctagccaggctgacaaaccatcacacctccagtaaaactcacaagcattgctgctgttcatttcttaccttctttttccccattcctatcaatgtctgactcaaatctccaatcttatctgtctcccattcctgcccctacttgtaaagctgaaggttgcttatactggatcccaggctcccttatctatccctagcctagtaggctcttacctggttctccctcttgagatactatttaggagggttccttaacccaaactctgtcccctggaatcaaataatctttgtcctgtgatttgtactctagtcaggtctgctcaggtctgagagggggaatttgagggccagttcctgttaactattataactttgtatttagggagggagtatagcttactagttaaaatcatggtctcttaacccatgggtcatcctattaattcaaacctcagcaattccgcttaggtgcaacttcaaccaaagtgacttctcctttccaaatctcagtttccttatctattaagtgggtaccaaatagtctgttcctcctagggttgctataaagattaagtaagatgatgcaattgatcttccactcagccccttgaatttttaaaaagctcaagctgatttccagctcacataacctgcatcaatatgcctgaatgtatgtttgtttgtctgttttaaaattttgagccataattgcagaaaatcccattgcctctccctctctctgtctgtgtgtgtgtgtgtacatgtgtgcacatgcaaacacacagaaaaccaaaagtgcaaaggagttacatcactaggagcagggtccaaccagtgaccatggtacaactccctcacatttcaggtgggataattccaaagcatgtgtattgcacagtattccacaactccctcagagaaattagttttcattattactatgatagctgccttgataccacactcattattgctcctttcatttccttgtataatttccccacttccacatctgcgttagacatcccaaataaactatttgagccatattcttggccttaggatctatttcatggagaacacaccccaagacaaaattctcagcatagttccaggttctttgtaaaccttcggtattcaatgactgagctattattgttatgggagaaacctgacctcatgccagtaggaaagacctcactctacgccacccaaacactaacaaaaggaacatgctgcccatcacagggaataatcagcctaggtctgccagcaaattgcagtcctgcctgcacgggtcactagccaagctgcctccttgtgctgtgagcccagaaactactgagggacaccactaaagtgttcctttttggcacaacaccccagcctccagcaaagcagactgcaagactggggaataagcctgtctcttcaggtggggtgagaagcctccctgacctgcccagaacaggtctggccagtgattgctccattgttccagatgccaatcaaaggcgaagccagggcactttgtccaaaaattggattaagaacctcagttgggcacaagcaacacccataaatctgtctgtagatcttttgcctgttacccattttgcatcctcagaagttaccctctataaaatttatctcccataaagagagtttcaggggattatccccaccaaagacctttcaattttgcaggcagattgccaaatccacaaactgattccagcccagatgtcctgggagtacactcttcactcccttggccatccctgaggctgcttccatgttgagtacttgcagacacaggcactacagaaccacataagttctaggcaaactccagcctcaggtctcctggatttccctaatgtaagtgaaaacagagcctcaaaactctttgacccaactggctggctctggtcactctgagcattttcaactataagggcaaaaacgttttcacagagtaaaggcaaagacttaggtacaaagaaaactcctcaattcctctatgatccaaaggcatctcagctttaattccagtagtaaaaaacctcctgaaagcaaagacccctgacactttcctctcacagccagcttccagattctcaccactctctcagccactccctaaagaatgttccttgtccatgtctttgtctgcttacagactaacaacatacattaaactgggatcatatttgactcacataaattcagcatccactgcatgtccaacaaggtgttgcttgaagtatcacataatcactaagagagtgggctctggtgtcagattatgttgctgcaaatctgtgctgtctctttctaactctgaaatcttggcaagttagataaacctttctgatgcagttttaatacataattccaaatattttcctcttctcttattcagaggtggagattatattcccttccctcaagtctaagtggacttgtaactgattgaacccatagaattcagtagaagggacactatgtgacttcttccaaggctcaattataaaaggccatgcaacttctgcctggttctctgggaacactcacacttggtgtattagtccattttcatacttctataaagaaatacctgagactgggtaatttataaataaaagagttttaattgaatcacagttttgcttggctggggaggcctcaggaaccttacaatcatgatggaaagcaaaggggaagcaggtgctttcttcacaagatggcaggatagagatggagggagagcagggaaaactgccttataagaccatcagatctcatgagaccttacacagtatcacaataacagcatgggggaaaaccaccaccatgatccagtcacctcccactggatctctcccttgacacgaagagattacaatttgagatgagatttgtgtggggacacagagccaaactatgacacttggagtcctgggccagtaagaagggtgactatcctgagaccagcatgctggagtggtcatgggtacgtgcttcagcagcagcaccagctgaactagttcttcagccatgccagcccagacattaagcacaggagtaaagaagcatcttagaaatggatccactgtttccaacccagctgttcaagttatcccagccattcatggaattccagccaaggcaccagacatcataccaggggaaaactgtccttctgtgcccttcccaaattcctgattctccaaatccgtaagcttactaaaatggatgttttttgctattaagttgtgtgattgtttgttacacagccatagccaacttgaacattctctaagcctcagtttctctatctgtgaaatggtgccaggaatggtgtctgccctatagagtttttttgaggaataaataattgctgtgcatctagtacaccataatcactcagatgctggtgattattactatcatcaccttcatctcatttaactgaaaaacatatgagttaaatctttttgatgaatatctcctagttaattgttgtgcaaactgtctcttctaattagatgaataaaagttattgatgaaaaagatgagcccaacttttaactaaaaataatatgtctataaggtatcagaatgtcatcagttctttaaaaatgcaaaaacaggtttggtaagtgtttctgtggtgggagggggcgatatctatatgcatctgtgacttcatgtttgctttacattcttctccatgcatatgtttgcaaaataattgacagaggcattacaaagggcaaagggatcgtgtgtatgtacacatgcctgcactcacagcttctatagtagttgaagtacccaaagtggtaactgacactccgattagtcagcttcatcattcccttccaagcctaaatgcttttattttctcatccacagatcgatatggctggcaagtaagtgtctgtctgccacgtcaggacagtgagacccttgcaggtcagatgaccttagcccctcctgcgagtcctcaagcccagccacgctgagcaggtgtctgagaagtgggccagaccacacttgagcatccagccgtcagcgtacaaaatcagatctgatcggcctgcggaagataaatgagctggagtccccccagccccagatttggtcatctctttatgagctctgaagggcctattagcagatctgatgagtgctgggggagatgaagtcggcctcgaacaacgttagctggcagaatcaaatcattcccaatccccctagggagaaggagatgggctggctttcagaggcagcgtcctctcatctccattgcctataaggtttatatgaacactcagttgggggaagaaaaaacgctaagccctttttttttccggtagaatcgactaagaatttcctcatatatctaatagcttctcctcaggcaatttgatgtccctgcttagacaggtgctctctcattttccctctcagagtctcagcttaggagggagctgcaccactcagaagggccagctgaagccagctcccttgtcaccctctctgagccctgcatcccactcagctagaaattggaccagccttcagggtgccgagtggagcctcttctgtgaggccgggcggcttggtgggagccacagggcaggggatcagaagttcagttcttggtagctggatgacagtgggcaattaatactatgcagccatagtgaactcctctgtaaaatgagacagcagattttgtccggacttggcagtgtgaagattaaatggaatcacaggtatccagctgatgagatgctcattgaaggaccctttcctttctctcattcagcattaacaggcagtctgcctttccaggcccaagaaaggggtatctggaagaggcaaatagcaaccccaggggcttcaacagcttattagaagcatgaaaaggaagataattaaatctagggcagactttgaagagaaggaaacatcttcccaaagaaaagaaaactgcaagctgataaatattttattccttacccccgcatctgggataacatgaaatagaccaaagaagacttaggtgtgaatcctgacttagtaattgtgtgtccttggcctggtcacttaccctcttggattctcagtttctacatctgtaaaataggaacaatcaggctatttatgttgtaaggaaagtatgcaaaagtgcctaaaagagtagctgacacctaggatcaggtttgccccaagtatcagttaccttctcccttattttcttttttttttttttttgagacgaagtcttgctctgtcgcccaggctggagtgcagtggcgcgatctccgctcactgcaagctccgcctcctgggttcatgccattctcctgcctcaccctcctgagtggctgggactacaggcgcctgccaccaagcctggctaatttttttgtatttttggtagagatggggtttcactgtgttagtcaggatggtctcgatctcctgaccttgtgatctacccgcctcggcctcccgaagtgctgggattacaggcatgagccaccatgcctgaccccttcttttcttatttgtctgcacaacttgcaactgattgcctacctgccttgcctcacagttctgtgtgtctgtccctgtgaactctcacattatccttcctctgtggtaaggctactcatctctggctgccttcttgctcaatatttttttcttctctgtagggcaggcagctctcgtaatcctcctcaatttttttttcttttttttttttgagatggagtctcactctgtcacccaggctggggtgcagtggtgtaatctcggctcactgcaacctctgcctcctgagttcaagtgattctcctgcctcagcctcccaagcaactgggattacagatgcacaccaccatgccagaccaattttttttttttaagtagagacagggtttcaccatgttggccaggctagtcttgaactcctgacctcaaatgatttgcctgcctcggcctcccaaagtgctgggattacaggcacgagccacctcttgacattgtgatgattttttgtctgtctgaccaccctacttgactgcaagctccatgaagttgggggctgtctgttactgactaaataacattttaataaaagttttaaatattgctttttaaataaattgagagacccttgcacactaagtgcagtgccaaggtatacaattgaggagagagaatgggacaaaaaagaagctgccctctgaggacttaaagccttcctttgtgggagacaaaaaacaaagccaaaatataagtaaattaaaagataattaatgtctgtaacatgtccttacaaggacagaaaccaacaggctgagatgagagaaactggaggaagtcactttaggcaggaccagctttcaaaagaggctccattcatggaggccatcgcataagacacatggatgacatgaggaatgaagatgaaccatctttcccgaaagtcaggaaaagagaattccttcaggcagagggaatagcatacacaaagatcctgagtcagagaagagcttggtgggtttttgagctgaaaagaagtttctgtatcagagggaagcaaatggcagggagagccacgtctggtaaacacaaggaatgagacaaggagtaggtcacagagctcagcagaacaaaatcaggtgtttagactaggtgtcagcaaacggtggctgtttttataaatagtgcctatttttgtaaatagtgttttattagaacacagccacactcattcataggcacattgtctatggctgctttcaaggtgccatgtcagaattgaatagttgctacagatacctcattgcccacaaaacctaaactatgttctatcatgccctttacaaaaaaaaagaagtttgctggcccttggtttagattatgcaacaagaagtcagtttgaagggcttttaactgaggagagatgtgatctgattagacactcagaacagtgcctggcacacaccagtttctcaaatgtgttccttgaatgaatgagtggatgcttagatgaataacgcttcattatccacaaccatataatattatcccctctgttagcacaaataatcggagggtttacaggactgagtgggagcctcccatccatccaggcagactacgttttccacagtgctaacagctgacggatacttagaaaattgaatgttttatgcagcttcagattggaaatagcagtgtggttttcaccacagggaaccctcttaatgtaaatccaacccaattacacacacacaggcaggcgccaaatttgcagcaagactgagtttcgcccagcagcaaatgaagcacagctccagagaggaaagagaggtctgtcagcgagggtgtgggagctgcagaaggcacctcaaccctaagggccactgctgtgtgtgactcatgtgtggagggtgctgggtagcttaaagagcctgaaagaaaaaggatgaagtggcttatgcaaatgtacagcaagctgcattctgcaattgcaaaatcatgaataggggaaattgctggaaaatcaaaagtaacttttgcccccagagggtccttcctttgaccagttacagagatgaccaaagccttagagaaagagactgagcttttaaaataacaaataattgcaatgagctttgtgagatacgcgcaagattagatatatgaaataatgaggtggagagatcaaacacaagaactggttaaattaaatatctgctttgggccgggcatggtgactcatgcctgtaatcctagcattttgggaggctgaggtgggaggatcataaggccagaagatcgagaccatcctgaccaacatggtgaaatcccgtctctagtaaaatacaaaaaattagccaggcgtggtggcatgtgcctgtagtcccagctactcgggaggctgaggcaggagaatcacttgaacccaggaggcagagattgcagtgagccaagattgcaccactgcactccagcctgggcgacacagcgagtctccatctcaactaaaaaaaaaaaaattctgctttgtggtcagggtcccatatcaccaccaaccaaccatgtagccgccctatcggggtaatgcctctgagcactggagggtcctccatttaacaccccctcccacaatatagacatgggggcatttgccaccatttgctatgtattcagaggtcccctgaagtccaaaatcaaggtgtgggcaggacaatgctttcactaaaggttctccagaaagatccttccttgtctttttctagcttcatttttttttttaattttttatttctaatttttgtggatattgagtaggtatatatatttatggggtgtctgagatgttttcacacaggcatgcaatgcgtaataatcacatcatgaaaaatggagtatccatcacctcaaacatttatcctttgtgttacaaacaattcaattatactcttttacttactttaaaatgtacaattaagttattagtgtctatagttacgctgttgtgctatcagatattagatcttatttattctaactgtttttgtacctattctttccctagtttctaataggggcagcaatccttggtattccttggtttgcaaccacatcactccaacctctgtctccattgtcatgcattcttctccctgcagatctctgtgtccaaatcacctcttcttgtaaggataccagtcattggattagggttcactctagtccagtatgatgtcctctgaacttgaatacatctgcaaagaccctatttcctaattaagtcattttcacaggtgccataggttaagatttgaacatatcttttgggaccacaaagttttaccctctgtagagctgtaagctgaggtcctatggagggaagaacccatggcatggatttggcattgttcccgccggctggagagggtacctggagaaggcagccatactccctcttgagtgaaggccctgggagtaggtgatctaagtgtccactcataatgaaaaccagagctcagaagactggaagtctaacccaatacaactgcttgccaccaaaaacaccctattctccagaggtctctgtgtcagccttttcccccagcacttccccagacaaacacttccctctctacctcttgtctactctgagtctctgtcatttggactttggcctctagattccccttcttctccagtctgccagccttccacccatatcagaggccaattctcctcttttccttctgtggccttttggtcacatgaaagagactagttaatactcaaaatctgagcccaaactgattgcccttcatcgaagttaggaactgctgtgctaataatgatgatgataataataataataacggactaatccacattcctggggtgaagatatttttcttccatcttagagaaagcccccttctgcccaggaaacatctggccaagtttctaatgtagcaaataaaaataggttgaaagtcacagcaatggaagttggaagttcctctgtccttcaaacctttgtcaatcagtgtgatcagtccctaaactctgtaatcttgtactggaaagtggtttcctgataggcctatcatctaattttaaataaaaaacattcactcgagactaaggattcagaaaaagtcgtctgcctcaacatgtcccaaactataacgtacatcagatcacctggggatctcgttaaaatgcagagtctgattcagcaggttctggatgggatttgagagtctacatttctaacaggatcctacatgatgatgctgatgttggtccccttaccacagcttgggtatcaagggtctacataagccctgtggaaagaggataattgcttatccagagcaatgtgtgttccagtcagaagaccacttgtaatgctgctctgttttaggcaatataggaaatcatccaagacaagtaaaaattaactcttgggcattcattgtattgtagaaagctaccttcttcatgaacaaaaagtaagggcttataaatatatttgtgttatcctatattggcagccatgccaaccaagtttctgccccacatatatctttatgaaaaactatattactagagaaataaagattttgtgatttcacaatagacctgattatggcagaaagtgggagaaaggttttatgcaaagttttatgtacatgcaattgcatttaacccttgctacaagccaacaggaaaagtgaagaaacagaggtcccagaaagttccctccaaaattggctctgagctccaaaattatttcttgaaacacattggccttcatggtctctgttaattgattccccactggtttttcatcattgatgctaaggcccacgttgtccatgtagagactcaatatgagtcaaacaaaaataagtttgcatccttgctgtctccttacacctcaacttactcccattaaggctgaagatattgtccagaccactccacagagctgatgggagactccacctaaggagaaactgccctgcagggcccctggagggagacactcaatgccaattcattttcccttcaccctacagtggaatcagaaggaagggatgacagaaacctaaaatcacccatcctggggtccccggagatccactgcccactcatttcctgcatgtgccaacttcctctccacggagtccagttacaaggcttctcacccatgacagcagggcagggagtggccagggctgaaataaaatagtgactaacttctgaataaaccaccggggtgcctggattgggacctccaccccatcctataactccctgacctcttatgggtggaggtggaggggaaatgaccaacagaaactgacttaagcatatctgaggtagctaaaaatgctaattccttcaaaacctgtacatggcatggttttccactgaagacctcagctctggaacctgatttagaattctggcattaccttttctaggtgtatgacctgaggcaaggtgaccctctctatacctcagtttcctcatccataaacctcataaagttattataaggtgcaaatgaattcatgtttgcacctacttaagtctttggctcatagtaagcattcaataaataatagcggtactattatttatgttttattaataccattgacagttccccctgccaatatagcttacctcctttttcctcataataggatttagagaatcagacactgttcaacactatagttgttgttttttctttaatcccctagtaagtacagtcagaatcccagggtgttcagttgaaataaccactgaaagtaaattccctagagccctggaacaggccagtcttggacagagtaataagcaggtctgatcttaaatgctaaatctcataggaatgtgtatgttccaggatcgtggtgttgagaacgagtccaaggtcctacttagattcaatggcaaaaacaaacaaacaaacaaagatgctgcgaatgactggtgatgaatgacatggctacatgagaaattcacaacaaacaaaatatgctactcactttgctttccatggtggtgtgggggacagagaaccagcctttgagtcaaaagagttagattcaaattctgactctgcctcttaatggaaggtccagtattagaaaagtaacctaacattctgggtcttgatccacttatttttacgagcagtggctgctctcattatgttatgaaaataaagctttagacacagaataaagaatagtagtatcaatatcctctctctcctccccactctcccattccccttcgatctttcttcctatctttttctttcttccttttttcctttcttcacactggctagtcttcccattctttctttctctgctttccctgttggcccgtgctcataaaatttcgccttggacaggagcacttcagcccttgccccagagcccatgtattgacccccagttccaaatctacaaaatcaaggaatcacaataagagtggaattccctaagcaactttgcaccccaaaatcaatcaatcagtaaatcagtttggtaaagcttaattcctcaaagcttctggtaggtattctggaaaagcgataaaccatttaatcaccaccactgattaagctccttctatatgccacccctgttttggtcattgaggatacagaaatgaaagagatcgtcttgtgctgaaaatgtggagtaactaaagtaccttagggactgatagcaggattgctagcagaggtcacagctgaattgacccttacaatttatttcagcagagcggtgagatagtatacgcaaggcacagggacgcccaagcagaaaaacatgaaatctcagaggtgtgtgcattctaccaccaccaattcccccttgaagtgccttcttcccactcctgcgaccaaccttccctttacccacactccatttcttggaataccctctatgctccatcccatgatccaggcttatgctcctcacactggttacctcccccaatatgagttacttagcctgtgtctactaatctctggtctaactgccatataatccaccaacccagttcagcgaatttcaaagaataacccaaagggaacacccatatcagaatctcttagacagcttattacaaatgcagtggccaatgccccacccatgattttctgaatcagaatggggaggaaggagtaaaaaaggagtctacatttccacaagacccctcattgactctactacacactcaagattaagaactacagatctccttcttgctgaggtgacactagctgataacagcctatccttcctgcgaatttactgagcacctgctataactgggcattctgtgagaacattttgcatatatcatctctttgaaagttattgtgttattaattggtgcactggtataagccaggcccaaatatttttaaatttaattctcccaacaactgcactgaacaagaatgaactctgtaaggcgttccttcttcttatatagtttgaagctggaaagcaacacaaatagctctgttgtgtacatatcctgtaccccagagactgaccttgtggatcgatccatccagtatgaacaaagagcagagaagaaagaaattcacccacagtgatgtgggttgagtgggcacaaaaggactcagatattatcccctgaactttcatttcagcctgtgagcctgtgtctttgacaaatgaaacagtcagataatgaaagagaatattcttagcaaacttctgcttctacatgtagggtatagggtatgagttatgctacagggttcttgactaagacagacttgagtttaaaacaaagctctatcactgttcgtatgtgagattttgagtgagtcaggtgagatacagatgatatgggatctacccaaaagggctttggggaattcaaagagatagtacatgcagcattttcaacacaaagtatcatgaggatgaacgtgggctttgtggcccccactctaatattcacacccagccacacttctgtctgtgctcaaagaatccccaagccaagacaccctgtgcattttagcagaacctcatcatctgctttctcttgtctttgtgttctcctgaagctcagaatttctcagcaggaaggtgaactgccagacaagaggccctcatcgcttggggatcatcatgaattgacagaaatccccggggagtgcccagcacagcattaagagggtttcaagagctggggacagaatgagggtgatggggaggcagctctcgctaatgggctgccttcagcctggctttatggaaattacaacactgagcctcacggacctgggcaagaggaccgcttctgagtgagtgggttggggaggggttcggctgcttccattgtggatggaagagcctggctgagctgaaaggggagctgagagatctgccaggatgggacaaagatctccttgcatttgccaacaaagcacatcctccacctccagccccttcatacacacaaacaccaccccgggttataagagtgatccttatccatgatgtcagggacctcacccacctcattttcctctctaaccatctcaaagaatagttattgaatgaatgaatgaatcaatgagtcaatgaatcaatgcatgaatttaaagaacccgaaggaccatcagccttgttttcagaagaaatctctcagttctgaaatatcaaatgggatggtcttctcacatatcgttgggaaaaactaaagaatattgatgccttctctttgagtgtcaagagctccatctaggacacttaagcatgttctttcatttaatctcctcctgacaactctatgaggtgtatattcctaccttcattttgctcaaaggagcctaacctgacacagagaggctaagtgacatgtctataatcacacaggaagaagtagcagggctgggttatgaactcatgatgctctgatgtcaaggctggtacttatttccactctgtctcctcaaggctctgtatattcctgtgaccatcttacagtcactgggatttattgtgtccttctcatctatttatacctcagaggaaattaaaagcatcatgtttttctttgtactattgaaccattttcacctaattaaagctagataaactctatccaatagaaatataatgccagctaaacatgcacgtttacatttcctagtggacacatttaaaaaattgcaaatagaaacaggtaacctcaagtttaataatatattttatttaacccattgtattcaaaatattgtcatttcaacatgtaaccaatacaaaaatcaaatcatgatgtaattaacattattttgtgctttgaaattcagagtgtgcttcatacttagagcatgtttcaaattaagccacatttcaagttctcataggcacgtgagcctggtggctgccatattggacagagaactcttatagggataagacatgggatccatcagcatcgaggagagaaaggagaatagaaggggcctgcagcactgctgctggtattctggtctcctagcccctcctgcagtgctcttggatagaaaaaaatctgcgaggtggctgccgcagttgcaggctgcctgctattcacattcctaaaggaagatcagagagaatccagagatgtcacaatgctgggtcacatccatttccccactggagtttctaatcaactcaagaggcctataatcctggctgagctcctgccctgggagggcctagtttgtccctgtgtggtatccctgtctctccttcttcaggtctgagaacctgagaagattcccctgggaacccagcagcataggcagtcaagtggcccagatcagtaggtgggctgtggactggggatcctaggacaaatccaacaagcaagaatccccctccaccctccatggggcacagttctccttgctggggctttctgccaacactactatccttgctgctcaggaacaatcattggaactccacactggaagcttctacttgctcctatcacaggccaggctgggccccacctttgagtatccgcagctacacatggaagcctgccaggttaagctgagcttggcacattgagcctggaaccaccccaatgctttgttggagaagggaagtgcccaaggcccatttgctgagctaccattcattcccaccaggcgcttggcaactgtcagattaataacagtgactgaataatgtttcctgagcacttactatagcccaggctggagcaaagcccttaacgtggattaccttgttgaagccattctccatacagcagcctgtgtgagctttatgaaacacacaattaatcgtataacccccttgctgaaaacgatgaattcccactgtgcttggaataaacagccaaatccttaataaggctcctgaggctgcccagacccttacagtctctgcagctctgtctggctcacactcccccttctccctggtctctgacagtgctcacccccttggtgttactcacaatcattgccagctgatgagccgacttggcagggctgggtgtgggcttgtgctcactctgagacagtggcagacgtttgtgggctgtctctgatattgactggcagcccccacctccttggttgtcatccagggtggaaaacactccaaagcggccaattactattcactgtgacttcacacacaccacacaccacacatcagtgcagacgcacacccagaacactgctctttcagcttttaagcttcttcaacattgctcatgctgtaaattaccagaaatttgcagtggattatcccagttagtatatttcccatctacaggcagtatcatcaccttgctggccaacagaagagcccacccctgtgaattaaagggactcttgcttcccaggacctagagaagcttgccctggaagaaacgtaatgattcctactctcacctgcacagacaatgctttcactccagcagcctcatgaaacagccagctaatccatagtccattgtgatgaccacctaacagatgggaaaattgttgctcagagataggtaacaacttgctcaaggttatatggtcaagaagcaacagaattgtgctttgcctatgtgttggcctttgaaggaaaggtcaggtctgggctgcagaggctctattgtggggatgagcctgtaaacctgagccccagcctcctgcagagctgtagggggctgcagtgcccagaggctgaggattcacttctcaaccttggctaccagtgagagagcaggctcattctcctctccagaagacttttttttttttctataccccaagctgtgactttagtgtccatatcatcccaccaaagacctctcaagccacactgaagagaagatgagttccagggtaggcccccctcagaagcctccaaggccatcactaagtgctgtcctctccatcttcaagacatttcccgtctgattctttctgcccttgcctttgccctgtgccctagctcagggttcagtgtcttttacctgggctagtgtcccagtccctctctggcctccctgccttcagcctcaccatctccagtccaccctggatggaggtttcaagagagaagtttctcctggtgattcctgcttgtacctcccattccgaccttccctattccctccagcatgtgtctcttaaatgaaacccttgtaactgaacctgccccttctacccagcccatggtgactcctaacaaagttgtaataatcactctggtgttcccatttgctcctcacatctgctaatgcagggcccatggtctagtaagaccctgagactccagactctgcttccctgcctcggagaggacactttttgagccctttccctgcactcactcccatcacctgtatccctgtgtctcttttcttcctctgatcacctgtacagtgtgacctaggagctggtgcaaacaaagattcctgggccctgcgccaggatgctttttttatgatatatatttaaggtgtacaacataatatttgatatacatatacagagtgaaattgtttctacagtcaagtgaatcaacatatccatcatcctgcagttattttttaaaaacctaaaatctactctcctaggaaatgtccaatctataatataatattgactatagtgtccttatgctatacattatatctctacacttacttatcctgcataactaaaactctactctgtgaccaccatctccacattccacaccactcccagcccttagcagccactggtctactctctgtttctatttgaatgttttgttgttgttgttgatgttgttgttgttttaagattccacatataagtaagatcatgtaattttttctttctttatctggcttatttcacttaagcacaatgtccactagtttcatccatgttcttgcaaatggcacgatttcctttttaatggctgaataatatttctgtgtatttggggtatacatattttatatatattcacaatgtctttactcattcatccattaatgggcacttaggttgtttctctatcttagctattgtgaataatgctgcagggaacatgggggcacagatatctttacaaggtgctgattttatttattttatttgggtgtatacccacaagaaggattgctgggttatatgatagttctatttctaatttttttaggaacctccatattgttttccatgacagctgtaccaatctacattcccaccaatagtatgcaaggactctcttttctccacatccttgttaaaacttgttacctcttgcctttttgataatagccacttgaacaggtgtgaggtggtatctcactgtagttttgatttgtattcctgatgattcaggaagctatgtttttaacaaactcactggacaattcacaagtccttgagatccatgaagtctgagaaccactaacccacaagcccttgtcatgggatatggcatgatccaccttggggactgagggcgactgtcttttccctatgtgctcttgaaaggccacttcagctctctgcccaggagccctctcctcctttatcatttacgaaatgtctccccttcctccctggtgcagcttacttgccactttctccaagaagtcttcctgggctccacaaagctgagctgctcatgccctcctctgtgtacttaacaggaatctgctttttattctgtgatgtgtcccaacttcctctgtgacctggagatctggagccatccagacagggtcttccactttagatgaaatggaagggtggggagaagggcaaataatggcctgaaaagaaggtggcccttcctgatcatccactacacatgttcacattcatcaatgactttgttctttcctactaacctataaggctggagctgccattcaggttctaacaggcgaggacactcaggcttgaaaagcacaatatggaggctgcactgctgataaatggcagagctgggcctgcacttcagctcctctggactgcagagacactgttaaggcatcactctgagaactggagacagtggtcataaaacggctgatgacaacctaagaccttgattcttctgctgtgcattttcagtccctgagctcccctctctgtgggcagcacatgcatgactctgagccaagcctttgacccagggtgatgctcatctgaagcccagcgtcaccatcataagtgtgggagccattctccacttaaatttacagacctgctttatactcccacagaaacgcagtcagaaaatgaccctcacaccaggcatccatcagaaatctgtgtgtaatttgtctttattacgaggaagaaagggttggcggagaggcgggtgggaggtggagggggagaaatcaatttgatgtcaggtttcaattgttgagttactaatctaatcagtgacaacttacccttttagatgtacggcttggctttccaaaaattagaaatatcctctttttccaaaaggctgttggaaaggagataattaccccaatacaatctgtgcttattctcagagttgtgttttttttttctttaaacacgacaacatttcctacatgtgttcagtgaagctgaaaatgctattttgataatgggcccacagaacgtttaacaggcctggatgacaatgtgagactttcttaaggaatgaggaggcaatgaaaagctattataggagtcattaatggggactgggaggtctgctggagacatcactgcaattctcagttttgctgttttcttaataaggttctttggagatcagatctgaagcatgatcttgccaaaacccagagccctcagccctgtccttactcaacctgaccctcccagctgccaagattgaaccctcctccctcaacaccctccccatttgataaagattgactaagcacctaccatgggccaatttccccattatgtgctggcagtgagttgaaaacagtctttgcgcctacacttcacagccccagaggaaggcagataaaaaaggagagccacaatcccacatgatgtgttccgtgatggggtagctctgagagagcagaaagtggggagcagctacagttcctggtcttaaaagatgagtagaattttcttagtgtgagaaactgagcctcattaatctggcttcagtcccacacccatccctgaactgaggcaagaagtatgaaatatgatctgattggccacatggtcacatacctagccttgaaagtgacaggagagtcaacccctggaaaaattcattgacttaaaataggggagaggtggttctccatagaattaggggagaaattctgttcccggaagcagagggagtagatactgaacaggctaaactagcagctgtccactaagcaggcaggcacctgttactgccaacagaggtcatgccatctttcagctctgcagctacaaaaagccacaactcctggaacttggctccaaaaggagttactttctatcaagccagtctcaataaccctccatttccagttctccccagaataatggggagcttgcacctccaagagtgtggacttggttgtcctttcagcaggaagagaggctaaaattaccttgtcattcatcctggtttcctagaataataaaaaaaagaaaagaagacaaaatggagtatctcaagaaactctccacctgcattaaacaacaagccagggagaacatgttactctggagaagtatctaaaagtctagaagccctgaaaatggagcaattcattttgttaagaaatgggtgaagaatcaagtaaacttatggagaggaggttatgctaggagctaggctatcatcctcaaagaaatgaatcctaataaatggcccacattcaaaaaattgatgagcaatttgctttctcatctggttcttgggagtatgcaaagtacccatgcacatgtgactttatgttccaaaaaagccccagaattgggaaaggttgcatttgataacaagaaaacctgtcccaagagatcaagcaaattccaaagtagtttttaggggtggcaatgtaaaccataaccaaggggacccattagtgtcaactgtattcaaaggatcataatgagatggaaacaactgcattatccagccagttgaagtcaaaattcccccgagggaagggctatctttgtatgagaaaaccatgataagtccctcttaggtccagacagctccttaaaggacgggggttgtcttgcttgggataaaagaaaaatgtactgacttccctcccacaacactgaggagggaagaagacaaactagagaagaaagagagagaagaaaaagtataggaggaaagaagagacagtccagtggatccacagctagtgaagatgtgcaatgtgtacaaatcatttggaaaatgggtatcttcttatccctttaaattagtttgttcctgtgatggaaacccttcctccattctgagtttgattgaagcacatggctgtgttttccttgtggttgttttggtttgtacgtcagttgattttgtttggtagaaagatgtgaagaggctatatctgacacctaaatcagtgtggctcaaaacaaggattgcatattagagatcagaaaaattatgaaaactcagggagatcctggagaaggccacagaaatggatatttgaggccatcttatcccaatcccaaggaacagggaggctgacaactgggctgtaaaattcaaaaatcaagaataaatgaattacatttatttcaaggtcttttccactgtaatataaaatatcttttgacaaatctgggtaacttctatcctttttttgtttttttagataccagacttcttagcacctttaactttttgcatgcaatcggactctccaaaacaccttcttcattctgagacaattatctctgtcttgcgttattctatttcttataccggtaggttttctatagaagcatttttcaaaaaccttattgtaacatctctgaccattttgcatgtgtccttatgccctacagatctggaggaaattaggaatgtggaaaagccacaggtggagatggagagaggatgttaagagagcctgagaagaaagtgggaatttgatttcacagggtatgtgacagcctagcccctgagctccaagtaagcaggaatcctatccgccttattcgtcctcatccctatgtcctcaggacccaggaaaattgctggtgaaatgcataggtgctcaataaatatctgtcaaatgaataagtgaactcttcagagctccgtgaattaagtgtatgacctaagaattaagtatatgactctatgattcatatcaacatagaaactaagcctctaaggagtcaggtggagttctccaaatcacagaatcacagggccaggataggaatggaagaggttttggctgcagagcctgcattattttcagcctcacatactactctctcttcctacttcaagagctatccttctgatcacctttgcccccagctttctgtttctaaacagtgatttaatcctcagcccattgcaacatttagaacggtggtcctccaccattagaaggtattagaatcatccagagctgaacaaacaaacctgaacagttgcaggtttctgggattcaatcccgagaaatactgattttgtagtgggctccaccccccaaaatactgatttcatgggcctgaatgagactttggaatctgacttaacctgggtccattgcaggactaatcccttcatggagggaccattttagtagcccactcagcttcctgcagatccctttcttatttttgtgtgtcccttggagcctatgatttttttttaggggaccacctttgtgctacttgagctttgtgctactctgaccacatttacaaaaatccagaagttcctaggaaattatgttctactggaaacttttaactattgagattcgagtgaatttttttggaaactcaactcccttacttcaggtcaggacacttctgaggtttaacttacactccagtttccctgtgggatcaggctgaagtcaacttccacaggtctgtgcctgagatcatgcccttgcttggcttccaactcttcccggtctaattttcaccttccttcccagctttcctttcctaagttacctgcaaatgaatcctcatctcagaatctgtttctggacagtcaaacccaaaacacacttcctgtctttagtttttcattgcttatattctaccctgcccaaacttggtcttccagaaagttgaatatgaacaattcaactcaaagtcaacacaatgtgaagcttaaaagtaggttttcccctatccctgaagattatacctattttgagctgaccatctttgaaactggtggagtcaggctagagagtggaaggaggtgtgcctctcttccaagggacaaaaatcttatacccgatactaagggtcagaagactggactcttaattgcttttggagggtgatgcaagatcgaggccatctccttccatgagagctccccttctatctgaccaacctgaagccagacccatctgcatagacctcactaggtttcacccctatttttcctccttacccctgtagaaatgcacatgacctctttatgaagaccccaaagttcatctgtcattattttttgcattttcaaaaaataatagaatagaaaatctatctatttatagggaactgcatgactgtgtgacacatctccctgttgtgaaatccaagctactgtcataaaacatttagaaacaaaaagggaagagaggagtaagatggtccaaagaggaagctcttgctatgtatttgcatttctatggaaacagtcttgggcagacatggctttggtcctctgtggtcagaggaacatgaagtcaggtgcctggcagctggtcagaggctgctgcagcagcaatttgcaggggacagaatggcataagagaacagacacccagaggcctccaaatctcctaataacagggaccaggaacttgtgggtttatctctctaaatgcccagctagtcctgtggcaatctccctccatgtgcacttgcaagtgggcatccttgccattttctccctccccctaaaagcactgtgcaaaaaaacatgagatgtagacaacagagagagaagacagatggactgctataagaccagtgactagacgataaggagaataacattttatgtttattattaacaaatagaacaggtacagttgccgccagtaattaaaagatggttatgcattagcagtctcaattattcaacttagtagggaaaaaaaaagaaaaagaaaaagaccaaaaaaaaaagacgactattttggaaactgatgaaaaaaacagataacaagagtcaacatacattcctcattaggaaaacaaaaagataaacaacccttgttaaagtaaaaataggaaaaaatgttgactatgataatgctaccagagtttgacaacaaaattgtaccttattaaaatataataaaatcattcccaatgaggcaaaacagtagaaaaagtagactgacatcattatagtttattattgttctacaagttctagtatccacaataagataaggaaaaaaaagatgtttaacttttaataaagcaaagctaaaattgtccctccttgcagatgaatttatctgtatggagaaatcaaaaagacttaactaaaaaaattaatgggattttaagaaaagtagaaagatatatgtttaatatacacatatgttgaatgcctgctgcatgcctttgaaccatggcatatcattttaattctcattcacactggcaagataggtctaaccttctgatcctacagatgacacaattcaaatctggagaaatttagtaccttactcagagacggtttctaactgctagaacatgaacccagtaatgactttcttacagctcacattcttcatatactagcccagcgtgattattactattaatatgttactatatgaacaacattaataatagcttaaaaggcactctttaataagtacgtcttatatgcatgcattgcactatgaatgaatgaataacctctttcctcccaaacaacagcaaatgttcctcaaagtttccacggccaaaatatacttcttcaataaataaaattttaaaaccatcaaattaattgctttctctaaatattattaatcatatgtaatctatgagcagagaggcatatcatttggaacaagaagtgatacaaaaaatgaagaaactaaaatgtatagggagagtgacatcagcaagatgacagaataggactttccagcactcatcccctaggaggaacatcaatttggacaatttatccttgcacaaaaataatttcataagagctaaggaaacccaggtgagagattacagcaacttggagtagcaaagaaataagaactgacacattgaagaggctaggaaggacagcttcacattatctgagtcacccctcccttaagcctgggcagcacaacatggagagataacctccacatgtgggagggaaagtgaaataagcacctggctttgctacaaaccccagcaccaggccagcttcaatgaaattcagcactaggccagcctccacagccccagactctaggtcagcacccatggatcatgcctccaggcctaccctactgtcagaccagacccattgctccaggctccaggccattctctacagccccataatgacacccaaggacccaccttctaggacctcctcagtgccagaacaacacctgcagatctcagttctaggctggcccatgaagcctcagacgtctggctggttccagcagccccaggctctaggccagctgccataaccccaggctccaggtcagcccctgtagccccagactccaggctggccccagtggccccaggcactagaccagcaactgtagacccagaaactaggttcactcctgcagactcactttctaggcccaccccagtaccaagccagccctgcaaagactcaagttccaggactatctccacgaacccaggtggcaagtctattccaacaaaaggccatcccctgatgactcaggctcaaggcccatctcagcaccaggctggctcttatggacccaggatccaggcccgatccccatacactcagctttaagcaggtccctgtggacccaggtaccagacctgcacacattctgacccagacaccaggccagcctgccctaggactctagcagcaaacccaccactgggacttacaaaatggtcaactcagaatctcagaactcaacccagactggagagttttccctgccaaagccaatctgtaaaaactggaataggtgcctacttctttgaacttgcaatcataagacatggccagaagggtaaaaaaattatctgtgaaacatgacaccaccaaatgaacaagataaagcactagtaactaaccctaaagaaagggagatatgactgcctgacacagaattcaaaataactgtcttgaagtccagtgagctacaagaaaacacagacaactaaacataatcataaaaacactacctgaacaaaatttgaagttcaacaaatagaaaccataaaagtgaaccaaacaaaaattatggtgctgaagcatacaataccttaacaggaaaattccacagacagcttcaacagcaaactccatcaagcagcaggaaaaaaatcagtgagataaaaacaggtcatttaaaattacctagtcagataaacaaaaagaaataaaaatgaaaaagaataaagaaagcctacaaaattatgaaacaccatcaagtgaaccaacatatactttacagaattctcacaaagagcacagaaagagaaaggagaagaaagcttatttattaaaaaaaaaaagatagaaaaattcccaatctgaagagggaaataaatatctagaatcttgaagcccaaagaacccaaaataaatcaaatataaagagatcttcactgaaacctaatcaaattctcagaagtcaaagacaaagagaaaaattgagaagcaacaaaagaaagaaaaattgtcacatacaagggaatcttattaaaaccaccagcagatttctcagcagaaaccttgcaggccaggagagagtgggatgatatatacaaagtactgaaagaaaacaactgtcaaccaagaatactatactcagcaagtcttcagaaatgaagagagataaggaggtttccagacaagcaaaagttgtaggagttcatcattagtagagctgccttacaagaaatgctaaagtaagctcttcaaattgaaacaaaagggtggtaactagaaacatgaaatcatttgaaattgtaaaactcaccataaaaataagaatgcagtggagtttagaatactctaatactgtaagggtgatgcataaatcactttttaagtctaatataaaagctaaaagattaaagtattaaaaattgtggtcattaaataatttggtaatggatacacaatatataaaagaggtacattgtgatatcagtaacacaaaatgtggggagatgaataaagcatagagttttgtatgcagtcaaagtaaagatgttatcagcttaaaatagattgttataactacatgatgttttatgtaagctttgtgttaaccataaaaaaacctatagtagatacacaaaagataaagagaaagcaatcaaaggataccacaaaaaaaaatctatcaactctaaaaggagggcagcaagagaggaggcatgaaacaaaagaactacaaaatagtcagaaaacaattttttaaataaccacagtaagtccttacctatcagtaattactttaaatgtaaatggattaaattctcaaatcaaaaaatgtaatgtctaaatagatttttaaaagcaaaatttaactacattcttcctataagatactcactttagcattaagaaaacatatagtctgaatgtaaagagatggagataaaatattccactcaaacaatcacctaaagagagcagaggtgtctatattaatatcagacaaaatagattttagtcaaaagctgtcacaagagacaaagaagatcgttgataaaagggttaaattatcaaaaggacataacaattgtaagtatatatatacacatatctacatatatatacatacatatatacatatatgtgtgtgcgtgtatgtatatatatacatacccaacatcagttttctctgtctgaaatgctctaagctgacttgaacagacatttctcaaaagaagacagacaaatgattggcaggtatatgaaaaaatattcaacatcattaatcattagagaaatgcaaattaaaatcacagtgaaatatcacctcaaactcatttgataatggctattatcaaagagacaaaagataacaaatggtgacaagaatgtggagaaaaaggaaccctttatactcagtgacaatgtaagttagtataaccattatggaaaatagtataaaggtttctcaaaaaaaaaaaaattatcatatgacccagaaatcccacttctggatataaatgaaaaggaaataaaatcagcatgttgaggagatatctgtactcccatattcattccatatctttgctattactcaaaacaacccgctgattttacagccctatggccttgagtgaacataggcagtaaccaggtcgtggttacagtggactttgggtgagacctggtgctgtgttggcttcaagtctgacctaacacagcccccgttgtggtggctacaggggcatgggtattactggctattattgggtattattcatagcagccaagacatggaatcaatgttaagtgtccattgatggatgaatgggtaaagaagatgtaatacacacacacacacacacacacacacacacacacacaatgagataccattcagcctttaaaaagaaagaaattttgtcatttcagacaacagaggaaacatggataagcctgaaggacattagattatgctaagtgagataagccaggaacaaaagaggcaaatacatgggccttaagtgagactctgagatgctttggggggaacatagcccatccctagctgttgtggctatggggaaagactccatctgcttgagaaaagtaaaggggcatttatcttgcactttaggtaccagctcagtcacagtggagcagagcaacaggcagcctcttggggtctccagttctaggcattgactcttggatggtatttctagacctgctctgggccagaggggagcccaccaccctgaacggtgagtcgcaggcctggcaacattcaccacaagctgactgaaaagaccttggcccttaaggaagcatcagtggaagcctgccagtaatcctcatggacctgtggtgctggtggccatgaggtgaggcttctctgtctatagaaaggggaggaaacaatgggaacgactgcatcttgtgttttaagtaccagcttagcagcagtgcaagagaaaccaggtagatgtctaggattttttctgtagtctctagccttttctctagtcctggatggcatctatggaccaattcaggggctagcggaactcactgccatgaagggaaggatacaagcctgtccgtcttcaccacctgctgattgtacagccctcgggccttgagtgaacataggcagtagccaggtagtggttacaatggaccttgggtgagatctggtgctgtgctggcttcaagtctgacctagcccagccccagtggtggtggccacagggatatgtgtgtcagccccttccagttccaggtggctcagcacagagagaaagagacactgtttgtacaggagaaggtaagggaagagaagactttctacctgataatccagagaattcttttggatcttattcaagataatcaaggcagtacccctatgagtctgcaaacaccacagtgttactgggctttggggtgccccctaatgcagatacagcttagatcataacactcaagtctttccaaatatctagaaagcttccccaagaaggacagctacaaataagcccagatagtgaagactacaataaatacctaactcttcaatgcccagacactgataaacatctacaagcattagcatcatccaggaaaacatgacttcaccaaacaaaccaaataagacaacagggagcagtcctggagaaacagagatatgtgacttttcaggcagagaattcaaaatagccattttaaggaaactccaagaaattcaggataacacagagaaggaattcagaattctatcagatacatttaacaagcagattgaaataattaaaaagaatcaagatgaaattctggagttgaaaattgcaactgacatactgaagaacacatcagagtcttttaatagcagaattgataaagcagaagaaacaattagtgagcttgaagacaggctatttgaaaaggcacagtcagaagagacaaaaaggaataaaaaagaatgaagcaagcctacaatatttagaaaatagccccaaaagggcaaatttaagagttattggcctttaaaaggaggtagagaaagagataagggtagaaagtttattcaaagggataataacgagaatttctccaatctagagaaaggtatcaatatccaagtaaaagaaggttatagaacaccaagcagatttaactcaaagatgactaccacctgccatttaataatcaaattcccaaaggttaaggataaggaaaggaccctaaaagcagcaagagaaaagaaacaaatgacataacaatgaagctccagtacaaccaaccaatttgtttcaaccagtgaaacaaatgacataacaactaagctccagcaaaaaccttatgaaacagcagaaagtggcatgacatatttaaagtgctgaaggaaaaaatgtttaccctagaatagtatatctggtgaaaacatccttcaaacatgaaggagaaataaaagctttctcagaaaaacaaaagctgaagaacttaaccaacaccagaccggtcctacacgaaatgctaaagggagtactgcaatccagaagaaaagcacattaatgagcaataagaatttttctgggctgggcgctgtggcttacagctgtaatctcagcactttgggaggccaaggcaggtggattacaaggtcagcagatcgagaccatgctggctaacacagtgaaaccccatctctactaaaaatacaaaaaattaactgggtgtggtggtggacgcctgtagtcccagctacttgggaggctgaggcaggagaatggcatgaacccaggaggcagagcttgcagtgagccaagatcatgctactgcacttcagcctgagcgacaaagcgagactccatctcaaaaaaaaaaaaaaaagaatttttctgaaggtacaaaattcactggtaatgttaagtacatagaaaaaacacagaatattataacactgtaattgtggtgtttaaactcatcttaagtagaaacactaaaagatgaataaatcaaaaataataactataatacaacaacttttcaagacataagcagtacaataagatacaaatagaacaaaaagtttaaaagtgggggaacaaagttaaggtgtatagtttttattagtttccttttggcttatttgtttatgcaaacagtataacgtttttatcaggttaaaaaaatgggttataagatagtgtttgcaagcctcatggcaacttcaaataaaaaaaatacaacagatacagaaaaaataaaaagcaagaaattaaatctaactaccagagaaagtcaccttcactcaaaggaagagaaaagaaagaaaaaaaaggaaagaaaagagaaaagaaagaaagaaagagagaaagaaaataaaggaaaggaaaagaaagagagagaagagaaagaaagaaagaaaggccacaaaataaccagaaaacaaataacaaaataacaaaatgtcaggagtaagtatttacttatcaataataacattgaatataaatggactaaactctccaatcaaaagacatagagttgctgaatggataagaaacaagacctagtgatctgttgcctacaaaagcacacttaacctataaagacacacatagactgaaataaagggatagaaaaggatattccatgctaatggaaaccaaaaaagagcagaagtagttacacttatatcagacaaaatagatttcaagacaaaaactataagaagagacaaataaggtcactatataatgataaaggggtcaattcagcaagatgataaaccaattgtaaatacatatgcacccaacaccagagcacccagatatatagagcaaatattattggagctaaagagagagatagactccagtacaacaatagctggagacttcaaaaccccactttcagtattggacagatcttccagacagaaaatcaacaaagaaacatcaaacttaatctgcactatagaccaaatggacctaatacatatttacagaacactttattcaactactgcagaatacacattctttccctcagcacatggatcattctcaaggatagaatataggttgggtcacaaaacaagtcttaacacattcaaaaaaattgagataatatagagcattttctctgataacaatggaatagaactaaaaatcaacaagaggaattttggaaatgatacaaatacatgaaaattaaacaatatgatcctgaatgaccagtggcttaataaagaatttaagaacaaaattgaaaaatttcttgaaacaaatgatactggaaacaacatatcaaaacctgtgggatgcagaaaaaatagtactatgagggaaatttatagctataagtgcctacatcaaaaaagaagaaaaacttcaaataaaccacctaaggctgcgtcttatggaaccagaaaagcaagagcaaaccaaacccaaaattagtagaagaaaataaataataaagatcaaagcagaaataaataaaattgaaatgagaaagaaatacaaaagatcaacaatacaaaaagttggttatttgaaaagttaaacaaaaatgacaagcctttagccagattaacaagaaaaaaagagtgtagacccaaataaataaaattagacacaagaaaggacacaatattcaactgataacacagaaattcaaaggatcattagtggctactatgggcaactatatgccaataaacttgaaaatctagaagaaattgacaaatttctagacacatacaacctaccaagattgaaccatgaagaaatcaaaaaccagaacagaccaataacaagtaatgaaactgaagtaataataaaaacatcttccagcaaggaaaagcctgtgactcaacagtttcacagctgaatcccaccaaacatttaaagaggaaataataccaattctacccaaactattctgaaaactagaagaaaatagaatacttccaaactcattctgtgggactagtattaccctgagaccaaaacaagacaaaggcacaccaaataggaaaactataggcccatatcactaataaatgttgatgcaaaaatcctcaacaaaatactagcaaactgaattcaacaacaccttaaaaagataatccatcataatcaagtgggatttatccctggaatgcaagcatagttcaacatagacacaaatcaatcaatgtgatacatcataacaacagaatgagggacagaagccatataattatttaaattgatgctggaaaagcatttgataaaattcaacagcccttcatgacaaaaaccctcaaaaaaaactgggtatagaaggactatacctcaacataataaaagccatatatgacagaccttcagctagtattacactgcatagggaaaaactgaaagcctttcttcttcaaagatttggaacacagcaaagatgctcattttcttcactgttattcaacatagtattggaagtcctagctagaggaatcagacaagacaaagaaacaaagggcatctaaattggaaagaagtcaaattatccttgtttacagatcaagtgatcttatatttggaaaaacctgaagactccaccgaaataattagaaatgataaacaaattcagtaaagttgcaggatacacaatcaacagacaaaactcagtagcattttatatgccaagagtgaacaattggaaaaagaattcaagcaagtaatcccatttacaatagccataaataaattaaatacctaagaatttgcttaaccaaagatgtgaaagatatctacagtgaaaactataaagcactgatgcaagaaattggagaggacactaaaaaatggaaagatagtccatgttcctggattagaagaatcaatattgttaaaatgtctatacttctcaaagcaatctacagatttaatgcaatccctatcaaaatatcaatgatcttcttcacagaaatagaaaaaaaagtttaatttatatgaaaccacagaagacccagaataaccaaagctatcctaagcaaaaagagcaaaactgaagtaataacattaataacattatctgacttcaaattatgttgcagagctatagtatccaaattggcacggtagtagtataaaaacaggcacataggccagtttaacagaatagagaacccagaaataaatccatacatctacagtgagcacattttcaacaaaatttttgagagcacacattggggaaaggacagtctcttcaataaatgttgctgggaaaactggatatccatatgcagaagaatgaaactagactcctatctctcaccatataaaaaataaaaatggattcaagacttaaattcaaggcctcaacatataaaactactaaaagaaagcattggggaaactccaggtattggagtgggcaaagaagacttcttgaataataacccacaggcacacgcaaccaaagcaaaaatggacaaatgggatcacatcaagttaaaaagtttctgcccagcaaaggatgcaatcaacaaagtgaagagatgacccacagaatgggagaaaatatttgcaaactacccatatgacaagggattaataactagaatatataaggagctcaaacaactctagaaaaaaaattaatcatgtaattaaaaaatggacaaaagatttgaatagatatttctcaaaagaagacatacaaatggcaaacaggtatatgaaaaggcactcaacatcattaatcatcagaggaaaaaaatcaaaactacagtgagatatcatctcactccaattaaaatggcttttatccagaggacaagcaataacaaatgctggcaaggatgtggagaaaagggaaccctactgctggtgggaatgtaaattagtacaaccactatggagaacagtttggagtgtcctcaaaaaactaaaatagagctatcatattatccagcaatcccactgctgggtatatacccaaaagaaaagaaatcagtatatctaagagatatctgcactcccatatttgttgcaacattagtcacaataagtcataatttggaaacaacctaattgtctatcaacagataaatgaataaagaaaatgtggtatatatacacaatggagtagtatttgaccacaaaaaaatgagatcctgacatttgcaacaacatgaatggaacaactttcatcatattaagtgaaaaagccaaacacagaaagacaaacattgtatgttctcagttatctttgggagctaaaaattaaacaattgaactcaaagagatagagggtagcaggatggttatcagcaactggaaagcgcagtgggcttgaggagtaattggggatggttaatgggtacaaaaaataaaaagaactaataagacctagtatttgctagcacaacgatataaaaataatttaattgtacatttaaaaataactaaatgagtataactgtactgtttgaatcacaaaggatgcatacttgagatgatgagtaccccatttaccctgatgtgattattatatgttgcatgcctgtgtgaaaatatttcatgtaccccataaatatatacacctactatatactcacaaagaattaaaaataaaaaaagttgaaaaaggcaaatacattattatctcacttatacatgaattctaaaaaagtcacactcatagaagcagagacagtagtatagtggtttcagaggctggtaacaggtcaaagggagcagaaatgggaagacgtttgttaaagggtataaagttttgtgaggataaatacattctggagatctattgtacaacatggtggttttagttgataataatctattatatacttgaaaattgctaagagagtaaattttaaatgttcacaccacaaaaaataagtatgtgagatgatggatatgttaattaactttaaccatttaacaatgtatatatacatctatcaaaacatcacatcatacactgtaaatatacacaatttttatttgtcaataatgcctgaataaactgagaacaaaataaaaatgaaaatatgttaccctaaataatttaatctaatttaatttgtagatgctttacctgatatccctaataaattttcaagccacatattatttttattgttaaaataaaggaggttgagaaggataggaagctttgtccaaaatcccatagttggaggcaagatacaaacccagatctatctgtcacctcctgctttccttccggatttagacttcagttttctagtcaattatctcaaacttatctcacagggacatactccagcagactccaggaacccattcattcctagagtaaaattgagtgtttggcctggagaaaatgggagatcctttctccacacaaaaacatagctacccaaaaccatatcatcagggccaagtgccttttatggagcatttaccattcaggcactttaccagacaacctcaatttatactcacacagcagcccagataaggagatactgtcactatcccccttttgccattgagaaagctaaaactaagagaggagaagtgatttgcccaaggtcaaacacttagtaaataggagaaacaagattctcatctagagctatctgaagtcaaaccaattcatccagatattccattgtaatcttaaatgctagggcaaatgtgctcacaatgaacttccaccctgcctctaatccctgcatcatgcaaattcttaagatttacctccaagaagctctggttcacagggctgggaaagccccaagagcttaacaaatataccctgtgactgttagattcattaactgtgagacccctaggacttgagagttccactggttgggctgggatttagttacaaagaccccatcaccggacaaaaagcaagttaagtccactttccttttctctggaaataacagacttttgggttccctgtccatatatggccagatcatgtagtctggggacaacatacagtagaatggagtatctactgtgcactgactctatcttggaagatggtctgtctcaagaaccagagacatgagcttgtgcctgtgcaaggaagtgtctggtcacttttcctactcagctatgacagccagtgagataggttaataaataggcagctccaaagaagttaggataagaagaggaaggaaatagttttccctagagctggagtgagctaccagcctgtatcaaatgtgccctatttatttggcaagttctgctgataaacaaccttgtccgctctctcctgctgaggaattcctgatatgaactgtcaaacatccacatccttcctgtaatccacctcctgtgtgaagcagagatttcttctggaagtaaagccaaccttgccatctcggctgccaggttggcattagaatagtggaatcttgtaagctgcaaccccccctgccccgcaaccagagagatgccaccatgttgtgctgggtctgctgtttccagcaaaataagcacatgtgtggttcactgccttccctggaatgtccgggagcaggaagaaggggtcctcctgccagactccctagtttcactctcttcgcttctctggaaaattttatctcatggaatcttgtaccttgctttcagaatgaccaggaatattctatggaagcagaatgttaaggaagatataacgcatgttggtgcagagaacaccagtctctgaatgctggacctttaaaaccttgtgagtacacagcatatctgtagaaaagtctacagtggcaaacacttcttgttgaactcttgtatttctagttagtgatgattcccaactctgcctaattgatctgtctagagaggatggcagggcttcaaatctaaaagcccagttaaaaagccctgagataaaacctccccccaaaaattacatgccagatacctatatactgattttttttatgaaaagctgatacccacagccctctataacagtactgtcttcccaaatataccttgctctcagagaatcagggttgataatatatgtcagggtgggtggagaacagatagagcctgtttgtacagtgacagtgtggctcattcatttattcatgcagttactcaaacagcaaatatttattaaacaccacatgtgagcaagaacatctattcagcacaatgagggtgataataggggatgcagaattgttgttgggtcacagaggcaggcatctaatctagcctagctgtggggaaacaaggatgccttccccgagagggtaacacctaagctgagatgtggaagatgagtaaaaacatgtgcaaaggcgtagggactgaatctgaggaacgtgaagaaattcagggtgactacaaggtagcagttgctacattaagaaaagtctcattaactaagcaaagcacgtactacatcagattgagccctatggggtgtcattgagatatttttagaagggaatggcatgggaaaaaaatggagatttacaaaggctcacctggctgcagtgtaaagaagtgatggacagggtgatccaggtgtcaggggagcctgttgagaaggctttgcagtgacctcagacaaagataatgaaaggcacatctatgtgttgtcagtggaatagagagaactggatggattgtgacttatttaggagataccatttaaaataaaacttgtacatataaattatttcaattttagatggtgtggtacactgagtagtggcctcccaaagatgtccacatcctaattcctggcatctgtgaatatgttgttttatatgatggaagagatcatgaagatgtagttcaattaagaaccttgagatggggaaattatcctggattatccagtttggcccaatctaatcacaagtgtcctaataagggaaagaggaaggcaagagagactggatcaagtggagatcaatttgaagatgctttgctgctggctttgaagatgaaggaggaggccaggagtcaaggaaagcaggtggcttctggaagtcagaaaatgcaatgaaacgttctcccctacagcctcagagagagcccagccctgccaattcatttcagacctgtgacctctagaactggaagataatgaatttttgttgttttaagccactaagtgtgtggcaatttgttatgttaacaggaaaccaatacagataggaaaactaagtcctggcccctgatagacatgtaataagtatgtgtttagttaatgcacgaatgaggcttagagaggtacagtggacgttctaaagtaacaaggcttccaagttctcaaacttacatggaaagttgaaaaatcccccttacctgataatagtggttaactcaagatgtgggacttggggacaggaggagaagggagacttacttttcactacagcttattatactacctgaatttgtcaccctgtgcacatattgcctatttaagaaaagttaatgacccttgtcttcaagtctgagggataagacaggtgtatagatcaaaatagaaaagaaagtaatcagtaacccaatgccacatctgaaggtaggtactgtgacaattcaatatttttggatatgctcagttaattaaatctgaattccagtgcctatctgctcaagctaccatccacccactctctttcttttcctcttcaaaggtttcaactctaaaaatagtgtacatctatactgccctgtcccttcttagccccatgaaattttgcatgtactctgcccccagtaaaatgctaagctgctcatcctcatagggaaatgatatcaactcatgggcagggcatgacttttgtagacaagagctagatttgaaacctagtatccacatcagagtaaccaagaaaaatttatttaaaccttctgagcctcagtttttctatctgtgaaatggcatcatgatgtgttataaggatttgttggtttatttatttgtttttgaacagaattcagtcaagcaatgtatgtaaagcatttggcatggtatgtggcacccaatacatattagttcaatttccctctttatgtattttcttcccttttccgcagtagccaaagcttttatcttagcccttagcttctccaaactttctgcagtataggacaaaattgatctctctttcacccctctcactttcctctcccactttgtttttttcatcctgtaatttgtgcaatagaaattttacaaggaatacaaaaagtgcagacatcattccagcattgtgaaatgaagatggcttaatcagacagttgtgctcatgtgggatcccctgggccatttataggcaccatttaagttcagaactccacacacgctcagtatgtttcaggtgatatatatggttgttacatgtaaacctatgttaggcagttcctgccacaaagatgctatgtaacacaccagccccaaactcactgccttccaactccactttcattctcatgtacacaaatttataggctgactgtgttcatctgatctagaattggttccctggggtggctctgcttgaagctgcaggacaaaggggtgtggatccagcctcatcctgagaccaggctgaaagggcagcagccactgagggtatgttcttttcaggtgatggcagaaatgcagagggaaagcccaaccacacaaacacagtgcccagtaatggcccaataaagtcacaaggccaatgtcaagaggtgagacggtacattctgcccactgtaaggccgtagcaagggagtggctagacactaatactagggagagtgaagcattgggaacaattatctaacctactacactatcaatccacctgaagtgattagcaagtaatcccccattcttccccagctccccttccacaaatcctcaccaggaattcacataagccatgaagactatgactaatgttggtagttgggtttctaaatcaatagtcaagaaaaaaagcttcattaaacgtgtcattaaccccctgaaattgtaagtattcataagcacgtgggtacataccttttctattgagagagtacaaaactttagattctcaataagaatttcagaactacttctctcactagcctcatattcacagccaggagcggttctttagcacagcagcaagacacagctatagtattaagttctgaacctgggatagtcaatggcctgatccagtttgtgccacaatcatcctccccaagaacttcactcagagcatctcagcctaaacatcacctcgccacaccagcctcccctgatcacttgagttgatacagctcttctcatccccagttacttccctatcccatcgcccatgttatttcctaggtcttattgaatttatgtgttagttattattttctgtcccctcccactagaatgcaagctccatgtccttatccgtcttgtccccaatcttaacatagcgtctaacacatagtggaagccccatacgtatgttaaatttatgaaatgaatgaatggatgaatgaatatgagcatcattgggagatgctagataaagctaacaacctagcatggaattcatgggtctctagagaatacgctccccaaggtgtttgtgggaagttttgtaaaagagtgtgttaaaatgtacacacatggtggatgggctgggagagaactatgggagaaaattaacaatctgtgctttgttcttcacttgagttatgcgtgattagcttccaatgaaaaagacatttcttcacacacacacacgaattcatgtgtacacacacacacacacacacacacacacagacacaccccccagagtctcttatatgtgagtctatctcctagacttgtggttctcagccagaggcaattttgtcccccaggagacattggcaaagtctggaaacattttaaattgtcacaacttggggtgggagagctactggcatccgataggtagaggccaggaatgttgctaaatatcttgaaacacatcccactttatcacccactacaaagagttttccagcccaatatgtcaatagtaccaagattgaaaactcttgttctagaaccagaaatttacacatgtttacacacacatccatggcatggtaggatccaaagaccatcttggctagccaactctctaatctctgatcatggtgtccagataacaggacttaatctcattttgaaatctctgtctttttaaagttttgacaaatatttaccagaaaacctcttatgaagccaacactttcatatctattctctcatttagggagtattgcaaaatcccgttttactaatgtggaagctaagactcagggaagttaagtcatttgtcaaagttacgcagctagaaattgcagagtcagggttcaagcacctatttcactgaattgtgctcagatgtctttcttccggccaccagcacttcacttcatgttctttatgaatagttttgttttacattaattttctctgtctggagagccccaagctgacttgctgcatatcagtgctccaaagagccctcttgtttagtcaacttccctatgaaaagatacagtgagcaccacctaagaagcatagatacttgctgctgctgctgctgctgcagaagcttctatctctcagttcatctttattacttctttgtatttgcacttgtacactgctgcagaagcttctatctctcagttcatctttattccttctttttatttgtacttgcgcaatttgggcagttccaggccttttctctcaaccccaatgtctgccagtctggaaagtgtcatctgaagccctcctagattcaggagaagtttcctgggttgtcgtccatagaagaatccctcacacaaggtcaccaacaacccagcaccttcccaggggtgttctcttggttctacagcaagacagctccactgtagctatagtgacatccaaagattaatgccattaatgctcccagtgccactgtgtaaatttttaactctttcctgcctgcatgttcaagttacacagccaatacacagcacatgataagtgcacagttaatctttcagattaatcttgacaataagcaaacaaacaataaatgaataatatgtacatacataaaaataacccaaaagtgttgttattcttgtggtacttgtgttttaatgaagaactttttatttagtttatctattcgttcaacaaatagttactgagcttctttgaagctctaaaccctgtgctagatgctaaagaaaaaagtataaacaaagataggcaagaccctgtcctcagagagcttacattccagtggcaggtctggactttggtcatggcctttttaatgcataattatgaaacagaataagtgatctgaggaaacactgtgggggctctgagaatgcttatcaggagaatttcactggatctggccagggctgggcagagaaatctttcctaaggaaagatcctgaagggccctaaccttaaaggaagattctccaatgtgagagtgttcatcacctgcagcaattgataagcatggcattgggagtaggatatgccaccctcctggggtgtcacacattccacatgtgctaggtgacaccctttgccaagaagcagagctgggctgaacattcagtttcctaggagcagtagctgagtgcagtaatctttagactttccatttgcttatcccccaaaataacttctgaaagtttggtgcctcctagcaaaggatatcatttttaagatggcaaatattgaaattgttaaacaaaactgtcaaacactttttaaaatgtaatcaatagtaagcatagtaatttcatacccaccatcatccatttaaaaaatgaacacgctctcctgtaacagtcagatattttacatccctcacagacttttaagctcatgcaatatattttgatgcttgaaaatctttaattgttcatttttatggctgcatagtatttcatggtgcatatgtaccacaatttctttatccagtcagtcactgatgggaattgaggttgattccatgtctttgctattgtgaatcgtgctgcaatgagcatacgtatgcatgtgaagaggatcaggaaaaataactaatgggtatagacttaatacctaggtggtaaaataatctgtacaacaaatccttatgacacaagtttacctatataacaaacctgcacatgtactcttgaacttaaaattaaaatttaaaaaatctttaattgatcatacctatctgctacaacaatatgtaaataaattgacttttaaattttgtttgtaatacctaggactatgtggttcaagtattaaaaagaatttcctctatatgaatacaccattattattactaagacatgaattaaagcaagatatatacattataaattttgataaatatttattaagcagaaagaaatcaattgtattggaaattcctctattaatggggatgattatgacaaattacatgaaagaaagagtgttcagtatcgattctatttcttttttgtgtttatacacattaaatgcccagaaaatgtgttcacaaaatagctacatagaaatggaagcttcttttttaaacattgttattcaaatcattattgcaactgactatggaacaaaaacatcaaaaatattttttaatgttttgaattatccttttggtgtcctagaagttttttgtgatagtccaatgcagagtaatgagactctcaataagcaaagatatggtcttttgtgtttcttatgggaaatgggagattattaaataatgaggagaaattttagtgttcttaatcagttggccaagtttaaggaaagtttatatggaagttgataatccaaaaccaaatttcttcatatgtctctccgaaaatacttataaatcttcagggtatatataccccagtttgaagaccactggctttgagaatcctatcagtctttaatcacctctaaagactgacaatattcttggtttttgttcaacatgttgaccctccccaatgtgggcgagaggccatctcagtggatgttatgaacagcctcatcctccttcaaagtgaagggccccctactggatttttcacactatatgccagtgcagggtggattctcctgttgagaattaaacaccaggaagagaacagagaggatggaatgagaatgggtaggacaacttggtctgggaggtcaagaaacacttaactggaacagtgacatctgactgaggtacaaaagattaatagaagtcaactggaccaggagggaaagtaggagagggagaacatttcaggcagagagcatggcacatgggaaaggactgaagaagagaagagcatgagggttcttatatgctcagaggaagagagtacaacttattcttcatgcaatgggaagccgttgaattgttttaaaggaggaactaacatggtcggatctatacttctctacagtcactctggaaactgatgattaccaagcccctgaagcataagtccagaagaggaatgaacaagctagcctagagcaaaataggactgccaccgcctccatactagacagcagaatgcaacctatgatcattacttggctctttgcagccccttcgcagtgtaccccagacactgatgtctccttccatctccatgctgttgagtcacttctctcaaaccctgacagtgaacatttggcttgctagtcccagaataagactgcacagctcttcattctctctctttccaaaccaaattactgatctgttcctttgttaaattgctttggtgcctgatgatctatacatttaggtgtaatcttctcccccagcaacttctccagatctttttatttcctaaacagaatgctggtgcaagctgttaataaatattttcacaccattacacatgatatgatcttatgagttgatatggcacctatggtatatcttatagtataacataacacaacataatatatttgagagttagtcataataagtttattatgaatgatttatagccccaagtaaatatgtacatgattaataataattgttattatgaaatgcatatttgattacccaaagcctttttagatagtgcaaagttccaggttaaactgtttccttgctttataaaataagatgagaaaaataccaaattcataactatgaataaatattaagtgacaaaataatatattgtaggtaagtctgagatgccctgggttgtggtacgtggagagatgtaattctttttttgcctacaaaactttttagattccttattgtgtcaagcaagtctttttataaatttccatgatatgatatacaaggtttcccaaacacatttgaccacagagcacttgtacagagagcaccatgctgactggcattctgcagaacatgctgcagaaaacacagtagctggagaatgtctcaagctttcttcatttcttagtgccctgggattcttagatcctacttaaacctgttaccaaatcctatttcttggcaagaacattcctcatcccctcttctaccctcaagtcatcttctcttgccaccttcagtgcaaaataatttttttccaagtttcagtttggataatttgatctccttatggtcaagaatcatgtcttactcaactttgtatattatagttgccagtttatggtaagcacttagtaaatagttgttaaggaatgaatagtaaccagcatacagcatactttataaactgtgactcttttcacccttctcctaaaacagaatataagagattacataagtatgtatagtgtatttcagggactcattgtatggaacttactgcaaatattcactggtgcttgtggtcttcatggaccgtgaagccagtctttgcattttgtgaaccttagttgcgtggagcaatattataatacttccaccactctctggtttcttagaagttacactgctcttcaactgttttaccctcagtccaagttctaggtaaatgattcaggataatccttctctttttttgttttcagaagttcataaccaattagatgaggagattgagagttgaactggggaagtaaaaatgtaacttgaacatctgaagaaaaccactttagtttctaaatgcattgactttccttgagttacagtaaaaagtcagacaagccacatctcagaaagtgctgtgtgcacacatttgtacattagagccctccaccccaagaaagccatgcaaagcatgcaatacatttcccagaaaaggcagcatcatgaaacagatcctcctgggccactgctatgtgcttccttccagctctgtagctgggtgttggactttctcattttctgttctgctcagaaaggcgttttgttcttgaacaaaaaatacctgggcagggaatctctgtcataactgcttaatgcctggtcttgggggaagagatggagatcactgtcacttccccagtgtggtatccaggaaggacagcagctctggaaagccaagccatgccttcaaaggacctgtactcatctttggccatctttggccaattgtctgtagtcatactcacaggagattgtaagaggaaaaaaatacaaatacttccatgaggatatcaaggcttcttactgccgaaaggaggctgttgagaattgaaacttctcttcagatccactgaacctaggcttctttcccctctagctctatctgagaagcaatatgagaagcaatatacaggagcacatattttggtgaagcaagtcttccttctagtacagattccacccttttataggactggaatgcttcagatgcagtgaccagccctaagtttacaaaaatcacgctgctcttgcacagcttccagtctagtgagagagaaagggatgtgggagaatgtttatgatatattgtaatacggacatttccaagagagacattaatttgggttaacctcatctgtggtactcaggagagctagtcagagacaggaatgctttaagtagatgttaaagtaagagcaggtgttaacactaaggtgggctatattattctataggaatacaaattatctaaatctaaacggagaaacacaatcgaagtttatttccagcttatgcaaagtctaattcagatgttcatagtgagacagctctactgagtagctcttgttcacacagtgatttggtatcctcatccacatcaatttaggggttctgctattccttaggacctcagaattcttcttctggatcttcaacagattgtcttcatcttcacaatgaggaatgacacagaatatagatctctcaagagattttaagagtcaaccaagaattaccttacatcactgctatccacatcacagtagccagaaatagccatgtggctccactaaatggcaaaaggaagctaggaaaggtaatttttctgtattctcaaaggagtagggaagtgtgtttgattatagtattggttatgccacaataggatttgccaaggagcaagagaaaggtatttcatgggaaaggaatggggatctggctttgaaagtacatggtggcctgttcctcaatgggagcaccaggaagaacagagcctttcaagaaaaatatatttggaaatcagacaggaaaactcatggcagactaagatatttgtggaagagggttgcaaagagtaaagttggaaagttggtcttggggtcagctggggtataagctggactattccagtgagactagttctttcctaaatagtacacacttggtctccattccctgtaaaagggacaagtccccagagaagtttctacaaaggatgatttgacctatttaaaaacatgagctggtctttccattttttatttttatgtccagagagaccccgatgtcagagacctaaagatctgcgagtgaatccagggtttactcttcaatgcaggagctttcaccaccagccttagcctcatgcaaactgctcccttagtgtgcacctggaaggcttgaaatacacagtccgtgagtcaagagcataggtaatttccaagcaaatcctaaatgttgggttcagagaagggagcttttgagacctatagaggcatggtctaaaatgtagattggaggccttcacagagaactctttagaagaagatgcaggccatcacaattagacttgatgtctacaccctgtcttctcactcacctttgtaggctgagagatcaaatgtgttgactgattctaacttccatcctgtcatggtttatttttttaagtttaaataattatttactttaatttcttttgataatataaacatattacaaaaattatgtaatatggaaaagtagaaaaaaaacccaaaatcttactactcaaaaattgagcattgagcaaacatttttctagaacattctctatatttaagatggagggaaggaaggaaggaaggaagagtgagagaggataaggtattacaatgaaaccatgttttacatcctggcatagtacttttatgttttaacagaagcagtgatatttattaaaaattcaaaacacaaaaatgaagtttcagaaaaactgtcttcaactgatccctcatgttaataggaatgccttcacttaaaactcttcttaaactactcactggggctaccctgccagctaccattttttagtctttcttgattccttcattgaccaaatatttattgagggcctaccctgagccaagcaagcactaggctaatgcagcaattagagggagcaagactgatgcagttcccatcctcaggcaacttagatagagaagagtgtttctagaatcatggctcaataggccagagagtctggattcatcgttatagtgtgaggcccaagaacctgcattttcaacaggtctccaggtgacttagatgcacattgcaatttgagaaccactgtgctagcagagattttatgtcaaaaaagatggataattcattgccaagaaaaagcatggcaggtaaatgattgtctcaagtcaggaatccaggtcaggagtgagcaatggtccagtatgatggagctagactgatcattatgcacaatcccgtggtgtaattatgggtcttccctgattcatatgcggatctgagttatcactgaaatggtgaggacatttcctttacagaaagcagcatctttacaggtaagggactttggcggatgtttatagcaggatatgtcctttgggtaatctactagatccgttttcaagaattttgatgcaggaatgttaactccgacgtctatgaatatctgccagcagtgacttctgtgtgctctggcaaatgtcacgaggacttagactctttagcacaaagattcccagagaaagggactgtgaactgctgaggattagggtcaactcagctagaagctgagtccttgtcttgaaatatgtagctaaaataattgtttttctctctctgattggttgaaaggagatcaaaattaaatgtgcagaagaagttaagatctaatgcgtatcctgaaagcgtgctcaagaaaggtctaggtgagagagaactgtgctttcaacatttaaataacactgcttagcatgattacatgaagccaggtagaaatccacttacctatttatgcaattatgaaaacggaatgaatacgctgtttggaggatatataatattcagatggaaaccttcaggtttttctttttctttttttttttttttgagacggagtttcgctcttgttgcccagactggagtgcaatggcgcaatctcagctcaccgcaacctctgcttccctggttcaagcaatgctcctgcttcagcctcccaggtagctgggattacaggcatgcaccaccacacccagctaattttgtatttttagtagagatggggtttctccatgttggtcaggctggtctcgaacttgcgacctcaggtaatccgcctgtcttggcctcccaaactggtgggattacaggtgtgagccactgtgcccagcctaaccttcagattttaatcaccctctaaccctttaaagccctttaaagacatatctttaaagatatgtgtttctaatgactaattataagtattattttataaaattctgaagcggtagaggtctacataaacacctgttagataataatatttatcatttgaatgagtgagtgaatgaatgcttgagaaaataaaatttaaaaaccagaaatttgtaaaaaaaaaaataaaaggctctgaaacgctaattatcataaactcagtatttttttccatgctagcttataaactttgtttatatatatttttagcaatattcagatctcttttttttattgacatcagtttaggcacgagaaaagttttgtgtttctagactctgggaaaataaatatcgattgtcatgagcagatttaactgatagccttataatttaaaaatacgattttaaaaagacagattcaaaattctaaaatcacaaatgactggtggcatacagacaggccataataccccaagtacctttgaggacatcacacattgcaataattgacattcatactaatgacttcaggtgatcaagaaatgtttatgttaggcctgtatattctagttaaaagacttggaggtgtatagtacaattaaactttttctccataattagtttctgatattttatgggattggcttttattatgggtagaattcacttgggcagaaagcctctttccctagtgactaggcttgtcagatatagcaaataaaaatacaggatgcccagttaaatttgaatttcagcaaaacaactaatcaactaatcacttttcagtataaatatatcacatcctatatttggaacacacttatgccccatgcaatatttgggacacaattatactaaaaaaattgtctttgaaatttaaatttaactcagtgtcctgtatttcatttggaaaccctaccagtgactaaaaagcaacctatatctcagaattggtacattctggaatggttgcacttaagaaatctggctaattctatgagtcaactccacagagcttttcagaagaactctataaacttgagaataaaacagccttctaatgcaaactactgtctttcctctgaaagtctcaagtcaagtgagatgaaaacttgagacaaacctgcaggaggaatgcaaataaagattataagctctaggagagttgatttcaaggagcaaattaactcactaaggccccttgtgaaatcacctccactgaaatgagttctatggtgagggctaagacttttattgaagacaaagtatcatgacactcattattaaaatttccatgtaatgttattggagatcctgtagtctgtttctgtccctcagtcttgacctgcctggaagtcttgtctaactctcctctacctgattagctgcttctttctctgcaagtctccatcttagctctaattccatgattctgtaattgcctgtttatctgtagagttcttccactagattctttgaaggacagggatgtattttctgactttgtattcccagtggcagaacagtgcctggcatgcaatgaatacacaatagatgtttgaatggatagaagagagggagaaagaatggatggatggatggatggatggatggatggatggatggatgatatggttgaaaatattatgttgtacttatggagaggaaaaagttggctcttatgcttgtgtaagaatagtcgtagtcactttattcatatttgttacagcttaaaaaagccaacttatccacaatagaaaaatggataaacaaactggtatattaacccaatggaattctacctaatagtaaaaaggaacaaactactgatgtagtatgcacaacatggataaacttcaaaaataccgtgctgagcaatagaagacatgtaagagtacataatatatgactccttttttgtgaacatctaaacatagaaaactaacttggggtagaaaaacttaaaaacaaagtttttctgggaaatggaaggtgctgggaatttactgggaaggggcataagagaattttctgggtgatgacattgctctatattgatagtaatttagttggataagtgcatgcattcatcaaaagtcaataaatgcacacttgagattcatgtgtttcattgtaagcaaactttacctcttaagagaaaaaaaaatgtaaacgaatactgaactctgtctacatgctgtagtatttagaggtattgtaatgatgtctgcaatttgccttgaaatacattcaaaaaataaaatggattgatggctggacagagagatacactgacacaagataaagcaggtatagtcaaatgttaatagtagaatccaggtgatgagtatacaagtgttcactgtaaattcctctcaattttgctgtattagaaattttacatgacaaaatgctgaggtgaaaaggagcttctggttcacataactatgcgaaggctgcacactagaaaggactctgaggttccctgaggatatttaagacctttctcagggtgtgcaaattacgtctgaggctttctagagaaacaattcatctaacaccagacacccaaaaaccatttggccaaactaggtaaaaccagagagaattctactcagagtatttttcattaccccagccattccagcactttctctcttggaaacactcgccgttatttaaaagcgagagtaaagccccatctccaggactccagctccttctcttgcacccattggcctctgtttgttagtgtctgactgagggaggccatgtcagagtcgataacaggtcgatgggagatgactgactccgagggttcgtgccaggctcagctgctctcttctgcagaagtgtgtgcctgaagatcactctccctgacacaatcctgcagctgctgaaggagaggatttactcggatgaaattcaggcccaaggggaactcgagcatcatgcccacaattagaagtgacatgtgacccaggagcggaattctggctgccagagaaaggagtgagctgattcttttgagttgttctgacttaagaaaactgcctttctaattcctctgcagagggcccagaaagttttctgtttgatcagttaaaatacaaaataataataatattgaaggtaataaatcccttttaagaatgaaaaatgtcacaggcatcttagggaagacagagggctgaagagttcaaccacgtactactggaaatgtctgggccttatggtgttctattcagagaagatttagattctgtccgccaacacacaggggagtagtgcactcctcatcgctgaaggtaagcaaatagacggtggatgagaataggagaggtccctaaagacgattaaagaatacagtggtgtatggactgaattgtatcccccctaaaattcatgtgctgaagttctgatcccccagtatcagaatataaccatatacgaagataaggtctttaaagaagtgatttcgttaaaatgagaatcttaggttggagccctagtccaatacgcctgatgtctttataagaagagaaacagacactaggagtgagcatgcacagagggctgaccatgagaagaagcagcgagggagccgccatctgcaagccaatgaaagaagcctcgaagcaaaccaaccctgcctctggaactatgaggaagtaaattatttaagccatccaatctgtggtattttgttagagcagccttagcaaattaatgcactctctgaaaacttctgggcagtgcattatccatctttttgacaatgaagctctactagcccagtggttctcaaactgcattgtgcatccaaatcatctgaacaacttttgaaatgcaggttcctgaacttcacactataaccatgagaacagtcttcctggcatattgaacaatgctttcaggaacattcttttgcactcaagttcagtgagaatgaggactgtcagtcttgctccctttgattccctgcactagcctagtgcttggcctaggctgggccttcgataactatgcacaagtggggcttgaagtagatggttttccaaattccatctctgaaggtaagctgcatgggggaaagctcttcaatttgttcataacatagaggatttctctgtattattccagacagatattctagtccttgacagatggtaggcatttaataagtaattgttgaatgagtgaatcttataagatgttctagagaactctgcgttagtgaaattgcagtgccaagaacagaatcttttaaacttctatgttggctcttgatatagttttattatatctattatttcatctaattattttatggtttgattttagatatttggaaaatacaggcatttagggagaacattaaagtctcctgaaatcccaaccctaaaatataactatggtgaatattttggttcattttcttcattcataaaaatatgtatttagataagttcaaaagaaattgcaaatacaataatttatcttttttccaaagattatattttcccattttgctacatattttctgaaataggatctttaacaaatgaataatattccatcatgaggatgtcatatttaatcacctaaaatttgacttaaatataatagaaaagaagaaaatgaatgtgcatgtccaaaaaaacattaattttggaagttgcatttagggaggtgaaatttgtttccatgttttattaggttggtgcaaaagtaattgtgatttttaccaccactttcactggcaaaaacctcaattacttttacaccaacctgtaattggctatttggatatctcctccttttcataattttttgattgttttatgcttagaaaatctttttccacattcaaatcagttaattaataacttccactttctttagaggtatttccattaccgaaataatacatgctcatgatgcaagttttgaaagtatatgaaacctaaaagaacttagaaagttgtctctaatattttgaacttctgttgtattccttcccatcaattttcagtgcatatttttatatatttgttataatatagtacctataaaattgtatatactaattttaagtttatttgtatgattataaaatgaacatctgatcactgtataaaatctggaaactacacagtaccatgtggagaaaataaaaacaactaaaacccaattccccaggcagaatcactgttacatttggtatacaatacttacttccagtttttttggttaaatgtatttttacataattgcagatgtgcaatatgcacaaaattacactgattttaatcatttattattttgcatctagaatttatactcatgatagaaaattacacatataaaaacaaaatgaaaaattaaaatcactaatagtagtaattccaaacaatatattttaataactttgtatattacctcatagagtagtattcatgtcttccttgaaaggtagtcagagaatatacatctaatattatgcatatatgtatatacatatatatcacataatacatatgacacaatacttgtattcacaagttgtctatgtaaggtaatacaaacagaagactaatgactgatgtgtactctttaagtcattcaatgttttttcctttcttctatattttgaaagtctctcaaccttgcccttcaagttaccaccttgatttaatgcagagacattctaccctgtactccctccaatgatgattttaattatctcctgaaaattagcttccttatgtcaacctggtcttcgccagtttttttcctccatctattattgtcttacggctttctgtttaccattcagaatttgtactctttttttgggttttagtttgtaaattttttttctacattttttttgttttttctgattaaacttttttttatataattgtagatcacatgcagttttaagaaacaatacagagaaattgtggtaacctttacccagttttccccagaattttaatgttaacatcatgcaaaatcatagtacaattttcacaaccaggttattgacattgatacagtcaagatacagactagttctatatacttcttgttgttcttttgatactcaggctcacctctgtccccctcctttggcctccccttgtacctgatccctggaaaccattaatctgttctgtgtttctataatgttatcatcataggaatgttttatatatggaataatacattacacaccttttgaaattttttttcattcagcgtaatatcttagaaattcaaataagttactggttttatttttatgttttgagacatttatataaatgatacatgtaattgtgagggacaaactttaaagtgatttccatgatcaagactttctagtatttatacatttgtgtaatcctttccccttgagtgtgagcaggacctctaattttcttctgatccatgcaatgaagcaaatgccatgtatgtgatttgttcatgtgtttttgttaagcatgtatcatcatcttgctagagtctctttctcccttgctgatttttaagaagcaatatgccatgaaggaaggagtcatattagaaaatttcatgtagcaaggaattttgagtggtctctaagggctgcagaacatttcttgaaagaaactagacctttcatttgtgcagccataagaacataattatcccaacagactgagggatatttgaagtaattccttccccagtggtgcctctgatgagaccacaaccctggctgtcacctggaatgcagcttggtaagatgctgaagtacagagtccagttaagccatgccaagatttctgacctacagaaactgtgatataataaatgtgtgttattttaagtcgccaagtttttggtaaaaccaatacagtaatctactgcaacttcctttttccactcgatgtcatacttttgagatttgatatattatttaattgttttacagaatttcagtgtctatacaaaccacaactcctctattctaccactaataaagggtgtgtttctgcttcttagacattagaaagcaagtgttttagagaatatccttatacttactcaggacatatacaatagtttctctacaaaatatatctcaaaatgaaattacaagtatatgtgcatgttcaacattactgtaatattgccaatttgctctcaaaagtggttgcatagattttgtacaggacaattcctggttccccacgttgtgaccaacacttggtatgatcaaactaagtaattttgctactgtaatccatgtgaaatgacagctttttgttccctagtattgattactgatgaaactgagcatttcatatgttaaatggtcacttgggtttcaagttaccgattcatgccctttgcccatttttctattgatgatcttttatttttgttattgattcataaggggctcttttatactctggattcttatcctttattgattataaattgccaaaaagctcttccaatttataaatgacatttcatttaacctatggtaatttgtctattttttcaaaatttcaaagtccagtacatccatctttttctctatagtttgcatattttatgcccggtttaagaaatgtttcctcccccaaagccataaagatattcttctacattgcttctaaatcatttcaagtttgctttcatgcttgggtctctaagcacttagaatttatacttttagggtgaagtcagaatttacttttacttttcctcatggttaagcaattgtcccagcttcataaattgagtagctcattttttattgacataaatgttgcttctgtcaaacaccagtttgtctttatacatgtggatctattttgaggtcatttattggttacatttatgtaatatgtctatctgtgagacaaaaccacattattttaattactaaaattttaataagtcttgaaatgtggtaaggttgattccagtgattatctttcttaaaattgaactttattattttttaatctttactttcatataaattttagggtcagtttgtcaagctcaataaaagaaacaaattaaaaaccctgttgggattgggattttcattgaaattacatttaacctatgaattaatttgtggaaaattgccagtactatgatactgattcttcctaacttatgcatgggaattgtatcacgatcctccaaagatatccacttcctatgaatatgttaggctacctgaaaaagggaaattaaggttgcagatgaaattaagtttgctggtcaggttaccttgagatgggaagattatcttgcattatctgtgagcccaatataatcataagtgttcttaaaggtggagaacagtcagtgtcagcgtgaagcaatgtgagaactgctcgatcagctgttgctggctttgaaaatatagagggtacatgaaccaagaaatgtaggcatcctctagaagccatgaacctagaaattcaggtggcctctagaagctagaaaaggcaagaatatggattctcccctagagcctctagaaagaaatgtagcccttctgataccttgattttagcccagtaagacccattttggacttctgacctcaagaatcttaagataataaattatgttgtttttagacactaagtttgtaataatttgttaaaccaatacacagagataggtaggtaggtaggtaggtagatagattagacagagagagagaaagagagagggaggcaataggaaactaactcaggtcagtgtgcgtggatgggtgtttgtgtgggcccgagcatgtgcatgtgtgtacttaaatttatggtagaagtttcttatatgtttgcattttgattagagattgttctctttataatatgacttatttactttattcaagactagctttgagtccaagtatactgtcatttcttttaaatgtcccacccttgcttaaaaagaaaatatatttcctgactttctcagagttatttgtcaagttctatatatgttcaataggaccacacttgctatctacactgttcaattttttatctcttctgacatttgaattactgagagagaagtattatattttccatattaattgtgaattttgcaatttttccttgcaatttcattcattttggggagtcatgtgcatataagttttaaataccattattttctacctttatctttatgtcattactctatttattcataaaatgcattttgtcttgaaatctacttttctgtattaatatattcacactatttttatttgtcttcactttcaagttttctatatcatattttaggtgtttttcttataaacaacaattggctggattttgtaatttttaattcaatttgtgagcctctgttctaacaagcttatctgctatatttattgtgttgactcatatatccatttatttctatcattttattttgttccatttactatgttttttctttgcttccctcttttccccttcttcctacctcccactgggtttttttcacccctttctccatgtcttcctagcctctgattgttttggaaaagtaatgttcttttattaattctgaatggatacttcaaatatttaatatgaacaagtggcttaggaaggataaagtgattaatatctcaatgcttgttcaaaacaatttaagaacttggaatcctccagctccaaatgtcccattctattttacctgctatttgtagaactcaatgcagtcattgttatttttatttcatactatcaatgcttctatagatctagttataagttaactaacataggctgggcaaggtggctcatgcctgtaatcccagcactttaggagggcgaggcacgtggatcacttgagcccaggagttcaagaccaacttgggcaatacggtgaaaccctgtctctacaaaaaatacaaaacttagctgggcatgaatgcacactcctgtggtctttaaaaattttacttgggaggctgaggtgagaggatcacttgagccctggaggcagaggttgcagtgagccaagatggtgtcactgcactccagcctgggtgacagagtgagaccctgtctcaataaaaaataaattaactaaaaataaataaagaaagaagtttcctaatgtcaatgattatcagtgcttcttctgctcctctctgtccttatgaattcgattcttatttttcctgaaatgtaatctttagtatctcttccagggaacatctgtaagtggtaagttcacttagtctttgtttctatgacaatatctatagttcaccatcatactgaaatgatacttcagctggatataagattctgggataatggcaaattttctctcatcccattgagggtattataagacagtattttggaatttctgattgctgttaagaagtttgctgtcagtacaattctttcctttataaacaacctgcttatcccaagttgttttaaatagctttcttttatctttgaggtactcacatatatctccaagttacctaattttcttttgttttttttttttcatatatgttcttcattatgtcaattgaggggataatttcaaaccatgtatttttatctttaaaaattttatttgattctatttcagtttaatctattcattcactcagtgccttgatcttaatagtgtatttattcctatactacctatgcttttagttatcttatacatgcatattttgcatttctgtcactctattatttgattatctcaatttgtgcctctctaatattatttgttatatatgcatttttataatttttgatactgtagctatctttagatagattttcatcacagtaatcctgccatttgattttagggaggtactttctattatgcttctgtactgtagaataggggtatatcatcatttaaaccaatttttatagatttttttaacttagtggatctagacacaaaactctgtgaaaagcacatctttatagactttatttttcatgagaaacttttcattttatctttaatccttttgttttagttttcttgttatttattcagtttattcagtaatatgagtgtattctttttatgcagatacaacttacagagtacgcaaatcttaagtgtatgattcaatgaattcttacatatgtatgcacgtaactaccacacaaatcaagtcgaacttttcagcactccagagggttcccctgtgctttcacccgattggtctatgatttggagtatatctttcagatttccaaagatagccaatatgctgacttacagcatcattcaacggtttcatctgtctttaaattttctataaataaaatcacactgtaaacacctttttggatttttttttttttttttttttgagactgtctcactctgttgcccaggctcactgcaacctccgcctcccagattcaagcaattctcccgcctcagcctcccgagtagctgggactctaggcatgcgccaccatacccagctaatttttctgtatttttagtagagacagggtttcaccatgttggccaggatggtctcgatctcttgacctcgtgatccacccacctcagcctcccaaagtgttgggattacaggcgtgagccacggtgccctgccttgcattttcttttattcaaaattatgtctgagagattaatccatgttgttgcgttcattacggtctttgctacctggtattccattgtgtgtatataccacaatgcatccaacccattctactcttaactggacatttgagttatttctaggctttgtctcttatgaacaaagctactatgagaatttttgtgtatccttttgtgtggtaggatgtgaacttattctaattgtaaaaattcctaaagagcaaaagtcccatttgacagctgttttccctccttccttttcctagagataagcactgtttccaatttagtgtgtatctttccaaatcaccatttttaaaaattctagacatgtataagattttattgtattttaacataacagccatcatgtgaaatatatcattgtaaaccttattgtctttgccatttaaaatatgtattaaagaactttctatgtttgtatacagagtgctcattcattgtttttatttgctacattgtattccattctataattgttaagtagaattatcattttattcaaatatggagtttgtccctcaaaatagatttaacagtatctcataagctttaaaacatggtattcttttttattttgtaaatagtttttacttcaattttatgactgtgcattgaaatttctgcagcatatggttgtttttccttatttaagttcccaattattttggagggaggttggatgggaagatatgtttaaattcaaacgattaattttaatttttagtgcattataatccaaaaaatagcctataaaatttcttctgtgaggaatttagaggcatgtattttgatataatatagaataattattgtatttgaaaagaggtattctatgtgagatattaaaaattctatatggagagagttaaatatacatatttacatgtgccatatcatgacaatcattactgcccttctttatttttgcttacatggtctgttttttgctaatgtctacttatatgggttctggatatgtattatgttaccaagttctttatcattataaaatgatttcttttcttgttcactgcattttgacttggaccttaatttgtctgaaattaatctgtcattccttttttgctgttctttcatattttcctcctcaattgtttcatgtcctattttttttctctctctctctccctttttttttgtaattttgtttcaggttattttcttcaaagaaacatataaatgaagattatttttgatacaaccaagagacttgattttctacaaagtggtatttcaaatatttacatttattgttgtatcaaaatgttaatcatatttctgtgtcctattttatttctgatagcttcctcttttttcgcttttttaaaattatggaagctgtactttgtttatctttatctaatcaggtaattgtgaaggtatttttgccactttcattgatcaaaatgttgtctttcattaatatttatccaaaaaccttatttaaaatacaacttatcatataattaaagttggttttgccagttactttgtgataacctctgtgaatggactaatcatataaacctatcatccaaacagggacatttgacagagaaaggaggcattaggaatgaatagttactatatgtataaaacaagagaactgtagcatgttctcatgtctcttttagttataccaaacttttatttagataatctaagtaatgtctcagattattgtcacaacattattttcatacgttcatagacagtttaaatgattttatatgtatgttcagttctatcttatatgtaagtctttgcccaataagaaaattattccttctttctgtaataaatctcagtagtacatttcttttttttttttttttttttttttgagatggagtctcgctctgtcgcccaagctggagtgcagtggcgggatctcggctcactgcaagctccgcctcccgggttcacgccattctgcctcagcctcccaagtagctgggactacaggcgcccgccactacgcccggctaattttttgtatttttagtagagatggggtttcaccgttttagccgggatggtctcgatctcctgacctcgtgatcctcccgcctcggcctcccaaagtgctgggattacaggcgtgagccaccacgcccggccgtagtacatttcttattatttcttttgccaaatacatcaaacattaggaaattggatctttgttctcttaccaccataactattttcttttaccccattcagtggccaaaaaactttttctctaaataaccagagagtaaatagtttaggctttgtggatcatataggatctgttacaaccattaagtttgccagtgtagcatgaattagccacaggtgatacttaaagcaaccactgtgatggtgttccaataagattttatttataaaaacaggtgggagtcagatttatcctgagggctgtaattgctgacctctgagccaatttgtcaacttgtctttttcttcatatgtttagttattcttagagagatctttttcatatttttttgcacgctgattatagttttactgcctcctatgataattttgactataagatgaattttttttcataaacattcttagcatttttttaaatcaactcctttttgtctttcttcctgcttttttttttttttggtctcggcatagtttaccttttaatgctctccacttttatttaacagaatcaatatttctttatattctatgaaagaaaccccaaaatttcctatggtctatgatttcccaaaattttaaacacatttacatatatatatttgtttgcttgattgtcattctagtttattatcactgaagaagtaaaaaaaaaaaaaagaaaacatttcacaatcccattttgtaacagtcagaactacaactcagctcttgacctgcccaaaatctccctggttgtgaaaagatcaaattcttagttctatagcagaacagctttagcccagttctaaatgcctaacaagcaccaaaaccatatggctcttctggattatgtgtgattttttcctgccctccactgcctgattcttcagtactctggaccaatggaaccaatggaaaaatagtaagactgccagcatgggcctccaccctgagtctccttccctgtgtggctatttacacagttacatcctaaattcctccaccaacaattagttgttgagagccttccaggagccaagcatttccctgagtgctaaggattcattggctaaggatattacatatcaagccaatgtgttagttacaaatgaactaatttcgaggaggtgatcttgaagaaaagaccaatgatatagctgctgagatgagatttaaatgattagaaggagccaccatgtgaaaatctggcgaaagaactgaccaactgcagggaacaaaaagtgcaaatgtcctaaagaggacatttatatatattatatattccaggatcagaaaggccagtgtggctgcagtatggaggatggtgggagacaaagccaaataaataagaaggaatcagctgggtgcagtgggtcatgcctgtaatcgcagctctttgggaggccaaggcgggcagataacctgaggtcaggagtccaagaccagcctggccaacatagtgaaaccccgtctgtactaaaaatacaaaaaaaaaaaaaaaaaaaaattagccaggcatggtggcaggcgcatgtagttccagctactcaggaggctgaggcaggagaatcactttaacctgggaggcagaggttgcagtgagccgagatagagccattgcactccagcctgagtgacaatattgaaactccatctcaagaaaaaaaaaaaaaaaagaaggaatcagatgacaatagactttgtaagccatggtcaggaatttggcttatgtcagaagtacaacaggagcactgggagggttttaacatggaaagatccatgatctgatttatagttttgaaagatcaagagaccaacatgaaggctattgtagtaatctaagtaaaagataattgtgatatggtttgcagtgtagtagtagtgaagaaagagagaaataaatggatttgagtttttagcctaatgacagtgccaatagattcatatgaaagttgaagaaaatcaaggaaccaagaacattgactatatttgggcttaagtaactgagaggagggatttattgctatttactgaggtggaaaaacttggaatcaagcaggagatggtaaaatcaagatttttacccttgtctattagacatctaagcgaaggcagtctcccagtttccaaagttgaactccgaggctatttcctctgtgtatttccagtgtcttttagaagttgttgaatccaaattgatgtaattggtagtactactgaatacctgtgtgtgaccaccttaaagagtcatgtaacatgtaacacaggagtcaaggagaaggtcaaggccaaggtttctactttatttcagtcatgagattttctgtgttgttaagcaggtaaaggtgggctgcctgctagttatgattctcaaggtggtgtcatggttccatagttaactaaatcttctcccggattttggcaatagattcattggcgcagcagatttttgtcaatgcctggctcatattctcttgatactcaatgttactcataccacaaacaattgaaattcaatttttgcctaaggacttttctggctgcagaagcaggcttgatctgtacatggagaaagccagaagtgctttccctgtttatttgctggacaaagaccccatcttcctgacctaggatggtacaattctatggtgtgttctacaccatcttccagaggttcccagaaataaaccccagcttcccatggaggtaacctattcattcatacaccttgtattggctttcttcccttctctctcattttcctacttttcctattagtacttcctagatttaattcccaaataaactacttgcacctagtctcagagtcaactcttggggtacccaaagtaagacagctattatctttattattgttttctggttatatgttttgaggtattctttgatttcatcaatattttaattaatagcatttggcctgatttaaaaaaaaaacatatcctagaatattttcaaaatacagaaaaagccaaaaataaaaaataaaaatcaccttgtaagccacagttaacattttgatatttgtggtatattttttctccagtctttctgctctctcttgtccttctttttcctattttcaagacaagtgaaaagagactatgtcagaaacaattccttaaatgccatttattccagacacagccctttgatatttgacataaggccgttttgtgtgtgcacaagctttactacagataccgttgtgtaaattcatgaatctggagaatccagtgagtactatgctcaatgaattgttttacatagcataatcactgactactccccaactcacttttaaaaacagagatcagaagttttgcctccattttatagatggtaaaacagacaaggcatggctttcatacatggaaggcatttcaaaggtcatttccttcactccttgaccgtattggctcatttctgctttgctttttgaaaagtcaatcttcttcgtgaccatgcagaattatctgacaagttaatgttgcctagctggcaacttgaaattgagtcattttaaaatctgcattgtaataatgggagtccctcatttctgagcctataactaattcaaaagcaattgaaatctcccaaggagatcacattgtagtgggaaacaatcccccagagtgagaccatgagacaggctaagtccatcaagcaggtatgcaggcaggcaagcagactccaggaagagggagaacccaaaatagaatggggatgtacagttgatcatcccatagtcaggctacttgattgactcccttaaaagtacatgttctcacaaagcaagctaatcctgatgcattgcaccaactgtaaacagagctcatatatttgtgcataagtctgttaatcaacaaacattattagataccatgtaagtgcagagtgctatgccctggagaacacaagggaacaaaactgcactctatcattgtgaacagctcacactggtttctttaaacatttactgagtgacttcaactgtgtttgtgtcagtgttaagcatgtttctgctaacaatcttgagatttggtgaagtacaaatataaaataattattacaactaagtaagtgtcattaataagatgtatggaaaggaatgagaaaaatttgctctatcaaagtaaatgtgtgtgacaacttagagaaaagtgaagtactatttgaatgagataatttttaaaagctatgaaaggtggtgaaatgtcaattgatttggggattcagaccatctccatgctggcttactgctccaaagaaaggaaaggcagccttcaatgctcagctctgagttttaatctagacttataagtccacagaaaatagtcttgagagcaaggctttcaagggagagaaaaggatcttctcagacctccttaaactccatgtttccatttaggaagtgaagcttagaaaaactaatcatagaccaggacagatgtggatatgtgggaaggaaatgtctccacacaggaagggttaaaccatcccttgctggaggatgcaaaagaaagtagagcaaagggttaaagactagcacctccctctccagttctagtgggatagagttgccccccaccccgcaagtgggcaggagttaaacatcgagatgagtataccagctgtcattctcccagtgccacaaggatgcataaactctccactgcatccatatgctatccaagcaaggaagtgaggtaggaggggtaaaacactggatgtaaggagaaaaaaaaggttgtctgagtcattaaccagagagagaggaagagagagagagagagagagagagagagagagagagattagggtttaaacagactatgtaattttaatatctttagatgacaagattgagcgcttttcaccaaaagaggtcctgcgaattagaagcaagagatagaaaataaagatagttgcattcacttaatgaaatgagttacttaaaaaccaccttaagatattagagaagttggtaaaatagggagctctttgatggcattatggagagggaaccttaaagtatttggatacttaacctgacaaaacgtatcttcctttaggttcactgatgagcaggagtgcttggaaccatagcagtacataggaaacacactttatgctgaggctttgcttcaaactacaaaatggagaactacattagcctgtgctgaatcagatagataaaactattagagatgattagctccaattggtttcacacctaaatatgtcactgggataccaaaaaaaaagtgatgaatacactttagaatgttcgagagaatgttcatcagtccctagtgcctagtgctgagttagggcagggtggatagaggcagtgatcctctctggctaccaggtaagaggcagaggaagagaagtctttgagggtgagaacaccaagcttcttctcatataaagatatcagatgggtcctatcaaaaactcctaatgtagataagagtgagaaagctgtgcccactttctctacctcatttcatgcatgatgattccatgcaccatggtttccaaagataaccccaacaattcatcctgtgtggttactatatgaatgtaaggttcctcctatcaagaggtgaagtctatttcccctacccttgagtaagggtggctttgtgatagctttgactaatagagtgatggtggaagtgatattgtacgtgatcccagcccaagtttcaatgggccttgtgttttctggctttgtgatttgggaccaccaccatgagaccaccacatagaccatcaggctagcctaccagagttaagagtccacatggaggtaaaccaaggcatactagatgacagttgacaccaactgccagacttaagaatgttctttttttcttttagatggagtttcactctttttgcccaggcttgagtgcaatggcacgatctcagctcactgcaacctccaactcccaggttcaagcaattctcttgcctcagtctcccgagtagctgagattataggcgcctgccaacatgtcaggctaattgtgtatttttagtagagatggggtttcaccatgttagccaagatgatcttgaactcctgacctccagtaatccacctgccttggactcccaaaatgctgggattacaggtgtgagccactgcgcccggccagaatgttccatcttgtatgtcccagcccagctgaccctccagccaaagcagccacttgtgtgagcctagttgaagccagcagaggaactgaccagccaacccacagaatcataacaaaaataaattgtggttgttttaagtcacgaagttttaaggtgatttgttatgcaggaatagataaataaagcaactaacaaacatgatgtgtttcttgtttctgacccatgtgattagcatcttggattccagggaatgatagcgggggcaccaatagaagtgcggggatggatggggtaagatcaagcagggagagtttcaagattccattgaaaccacccaggatcaactgggtttggcattacagcaatagctccatttttcctttccactttgcttgttggagagtgcagagaaagaaacactagcctgggagtcaggacctgtgtgttctaattattcaccttgacctttagatgacttaagccacccatgcctcaaaatgctcaactgccctgcctatctcacaccaagggctattgtatggacttaaagagaaaaacaactttggaagctctgaagcttgttgcaaacatgagacattgctataaattagatccaatgctattaattagatccattgctatttattgaaaccacaacctcctcaaattattagatgggataaaaggaaacattttatggctggaagtcatcagtactatcatcttgcaaatacagacctttatagaaaaggtgtgtccagccttggaacccagagcagaaagagcaagttgtcccagaaggatccctaagccacagaaaggaagaaaatctataaaaacatgaatcacctgagccttctgtcctcattttcagatctacaaaactggaaaatgtacaacagtatttacagagctctccatgtgctctggggatggaaaatgaatagaactagccataactcatcacctgtcatgtgccggatactctgtgaagatgtcttctatgtgtaatcttcattattcccttcaactgtcctataggattacagaaaattgatattcaagaagataagctatactataaggttcaaaggaggaaggtgatgggattggaaaagtttctatggatgacagagaatatgaggtggtttcaaaggataggtaaaattttaaatggaaaaaataggaaaaactcatactgtaaaataagcaagtatgaggtaaaaaatgataaaacaggatgctcgtggggcaccatttggctggagcagagccgtgtatgtagagagtagcgggagatgagattagaatgtggggctgagactctatcagcaaggattcaaccaaagagtagaaccagtaggaaatatatggacttgctacatggaagcaactttacacaattgcggaagctggttaagcagtctctgtaaagctgttgttctttgcatctgatgctggagctcaaatcctccatggcaggcagtcaggaagggaagaagaagagtgggctagaactcttagaactcaacaataaaagaacaaataacacaattttaaatgggtaaattatctaagtagacatctctccaaagaggataaataaataatcaataagcacatgaaaagatgttcaccaccaatagccattaggtgatgcaaatcaaaaccacaatgagatacccctccatacccactgggatgtcaataatcaaaaacgcagataacaaccagtattggaaaggttgtagacccattagaatcctactgccttgcttagcaggcaatagaacagtcaattagaaaaacatttggcagttgctcaaaataagttctcatatgacccagcaattccactcctaggtatatacccaagagaaatgaaaacacatttccacacaaaaacttgtacacagatgttcatagtactgttattcataatagccaaaaagtagaaaccatacaaatgaaagagtaaacaaaatgtggtatattcatataatggggtattattcaacaataaaagggtatcaagtactgatgatacatgctacaacagggataaactttgaaaaaaatgctaagacaaagaagccagatagcaaaggctacatattgtatgattccattcatataaaatgttcagaataaacaaatccatagaagaaacagaaaatagattggtagctgcctaggattggggttgggcaaggggtgggagagggggtagaaatatggagtgactgttaatgggtatgaagtttcctttcggggtgatgaaatgtactaaatttgtttgtggtaatagttgcacaactctgaatatattaaaggcaaataaactatacattttacatgtgcaaaatgtatagtatgtggattatatcaaaatactggtgttttttaattaaaaataagagcagaaatgaactggaaccccatgaggatgggctaaaatccttgtccatttttgttgcttctgaccttggtgatgaaggagtcctgcagaaatgggatctctttatcagggagctaagtgcacatgcaggtctaggagccagagaagctaaagagggatccaggggcaagtaaagcaattcatgcccaaatgcttcttaatgccaacgaggtgaatcagcacattcccaaccatgcatgctgcaaaatggctgccactttccttctgccctcccagtctcacaagaactttccttgtggctcaccctaactggaaacgtaaaaaagaggaccctaggaaatgtagtccagcctagccaagttgacacattgcaaagccattacagactctattgctgggagctttgaaggcaggaggagacattcttcagtgggaatctacaaagtgttaaaaatagggaagtaaaatattctaacctgagctttggcaaaataatctggcagcaagagggaaaatagtatgtagagacaggaagatcagctaaggatctgttgcataagtgagagttagtgaaagtctgaaaggagggacatgggaaggtaggaggagagagagagacagaaagaaggtggattagttctacttcttagtgtcatatgggcgctgtgttaacatattggaaataagggattaggtaaagaaagaaaagagacataactgaatttttaaagctccaaggctgagaagatggagttaccattaacagagacagcaatccaggaaaagaagcagattcgggcaaaagaaatgatgaactggccaggcctgtaatcccagcactttgggaggccaaggcaggcggatcacgaggccaggagatcgagaccatcctggctagcacagtgaaaccccatctctactaaaaatacaaaaaattagccggtcgtggtggcaggcgcctgtagtcccagctacttgggaagctgagacaggagaatggcgtgaacccgggagacggagcttgcagggagccaagatcgcaccactgcactccagcctgggcaacagagcaagactccatctcaaaaaaagaaagaaagaaagaaagaaatgatgaactttcaggtgtgatagtgtgacctatctggaagtcaaaaacttaggagtaaaatcagaggtttgagatacagtctctgaatcagtctctgtagtggtcatgggccaatggttcagatcaacaagagggaaaggatgtagagagagtggagaagggtcattgaaagcctgagggaagcactcagagaaacagcaggataatcaggaatgttagacttcccagaaatcagatggtaatgtttcaggaagaaatacgtaattacttccaaaactcaagtcaggactaggtatacactgtggtcacaacaccaactagattgggaccaacaaatgctgtagaatgagaggtggaattttttatcaagatttccattaaagagttgagctttcagatccataaatacagtggtagataaggtgagcaagctagggcatgcagtagtccaaaagcagaggaaaatatgttctaagaggtgattttgttgatgttattcatcagccatgctttccctgtctaaggcttttgaaggtcacttagtgacagatccagagccagtttttgacaacaatgatgacagcaactttgaagatgtttgacagaaaacaaaagtggggagaaggacagtgtgttgagtcttaaagcactgaaagatggtcttgttggatggaggaagtttggacatattggcaggaattagaatggatggaactgaacacaaagcgaggatgatgtagtctcattctggagaaacatcgtggactcattggaaaagtgatgaaattacaaaggtgtgaaaccctggaaaagtgtcaggtatgtgggattcctgcatgcactacattcgtcatgacggcaaaactcacccactggccaggagagcttgaaatcatttcctcaagggaaggccacattgctgaggaaatcatccctccctggaaatttctgatcctgattcccctcatttctctagaaatgatatcttaattgatttttaatcattttcatttctcaaagttaattaccctctgaaggtgcctacctatgtgtgtgtatgtgtgcatgtgtgtatgtgtgcgggtgttggtgtgcatgtatacacacaactgtgatcatctgattgtccttcttcatgaaaaataatattgttacaatcttgatactacatgtaaatacagttgataacaagcctttcaatacagaaaaaaacaaaggcaaacaaacaaacaaaaaaatcctgggaagtgtcttcacgttaatgtctaggttataatttctcacattttttcagtttcttacacacttagtgtctcagtaatattctcctggcaagtgtaggccaaaaggaaaacctgatccttttattagggagttaggtccaaaacactcagtatttatgtcttaacttaacagctattgaaaagagtaactcacatacattcaaataaattctccaatcacctggtctccaatcagcctcatctttgtttcccacacttctctacctgaaacatcctcccagctctgtctctacccacagctcctgtcctcatcacacagctcaagaatccccctgcctgtcatggcctccctccactctccaagagaattgctcacgccttcctctgtgcttccagaggactctgcccctgtccttaacatgcagcatcacagttattcactagtgagagactgcataccttcaagtgagggaacatgtttaattcatggctctttcctcagctcctaatggggtctgccaccttctaggtgcttactccatgtttattcattgaatgaatgatcgacgtcaccaaactcaccaagcaactttgaagtgaaaatgtaagagaactgtaggtgccagcctacatataaatgcacagccacatatacatatgcaagtctacatatacgcatgcatttatatgcatgctaacataaacatctgcctacatcccagtcgcctgaatagtagttctggatcctctccctgggaagaacacagagaaattaaataacttgctctgggtgggtcgcatggctagtatattacagaattaggattcaaactcaggcagattaactccaaagttcatgttcttgactaatgtgcactttgattctcattcctcccagcgaaaggtcttaggaatgtatatacaaccaggaagtcttttccaaaataaatgaagtaacataattatactttgcccctatcctccctcctgctgcccaattctccctctgactactcatcattataaaaacatatgaattcgacaaatttagcaagtgggcatttatgactctcatcttttccatgcattggaatactgatctgagcaaaatatggcctttgtcatgaatgagaaggaaagacagagacattgaggtctgtaagaggacaatgcacaaggtattggaggagcattaaataggagggagcaattcaagctgcgaaaaaagatcacaaagccctcagaggagtaggataccggggccataaaacccagggttcccattcaaaacagccagataaaacatattccaaaagatgtagtcaattcctgaatgaagcagatgcatttgagcaggaaaccaggaatcctcccagatgtcccaaagccttgagcaagccattcctcaatgctgggcctcagtttcctcctctgcagatgctctatggagcatgctggattaaactatctttagctctaaaacctcacctcatccttcattagattccatatatatgataaagtattcataacagtgttccaaaaataagaagaaagcaaagaatttaaagtaaatgcagttattttaatcttgggcaaaataacccagagaactaagggaagagaccaatggccacagaacccatgggtcttccagccctgatccatcatctcccttctggaattgcagagcaggagcacttcgtgctccctgctgtttctcatactctgaaacttacccgcagtgagcactgatgaatatcacctagcccctatcctgtgccttcagttgtgctagaccttcaatgcctatgttgccttgtttcatcttctcaacaacactgtaagacaagattatcatctcatactgagaaaacaaactcagagaaattaagtctctggtgtaaagtcacacagcaaaagtcagttgagaatccagatcagtattattttccatttaaccttccttctgctatggcacataaccagcttttacagtgggcaatagaaaagggatacagaataagaaatgagtctagaacaagggatgtctacagagacaaagcccagggaacctgaagcttttattagctgaaagctttcccagcatatccatcctctgttaaaagcacagagtagagactgggcacagtggcttacacgtgagatctctgcactttgggaggccaggaattcaagaccagactgggcaattagtgagatcccatctctacaagaaaaaaagcacagcccgtaaacgctttgattgtttaacttaatttaaaaggaggtatcttgcattactattttctttccatgactgcttgctgttgtcttcccttctctcaagtgctccccacagctggttgttgtcctttcccatccttcaaatttcctcaagaaaatgcctctactggaaacaaatcctgagaagggcagctcctggactttcctgaacatgggacaaagtatgtcaagcatcacacttatttaccctagtttgccaacccagccatcaaacggcccaggcatgtgcatcggtttagatcttctgagaagtgggagccaaaatggaaatagatgtacaagagatttattgggcgaaggatctgtaaaggataaaagggagagaaaacagaagattggagggaacctttggactgcaatgcaggtctgacacttgacaccaggtctgacacctctgaagacagaggaggaaagaaggaaggagtgcatcacaaatttgcagcaactggcatctgtcagctcactacactcctcacagcaggttatttcttgaaaggaaatatgggaagcacatttacgtggctgccacacagtttgatcttctccaaagtcttctgcaattcaagtagattcctgcaccttgggaggaatgatcgactctctggaaaaagtggttacattttgcagggtcggttcctacaaaacctgcaaaaaatagtttgtttatttaaaaaagccaggatgtcttcaaagatacacctgtctcttgtattaatgtcagatagtattgaaaggatggtggaaaaggggtttcgttacctctaatgagtatgatttagcaaaaaataaagaacagggagaaaaagaaaatccaccagaagaacagttctgtggagaatcattatctgtcacagaattcttcacatataaaatgctcactaatatgtattgactgagtgaaccatttccatatttcagctactgacctctactttaatgtcttctggtggagaccatgcattcttcaagcatatatgtgcacctactatgtgccagacattatactcagtgttgcaaatgctgagataaatatatatggctcctgcctttaagagatgaatacttcaatgggaaaatattcagagtaaatggaaatataagcaaatatttatttttaagtgctcctatagcaggatgaacaagacactttgatgactgctatgattagcatgtaatctgttgcaaggaacataaatcccaattcaaattggcttaaatagggagatattgcttctcataagtggtctcttggaacacagttgtattttcctctctttctgtgtccaggaaagtcatctgcagcctaaacgtttctctttcttacagaaccttcaaattcatgcatcaatacccctattttttctaccaagtctcctaacactacagccttgatgatccctttcccaaggtgtatgggcagctgactaaccacctggagtcctctgtagtgcccttgtgccactcaaccaattccatacttcagggtttgttattaacaatgtcctactttctggaatcaagctctctatcatataagatgccttcagttgtaaataacgaacaaatttaactcaaagtagtatttactaaaaagaggatatctgggcgaataacaaagcccttgatgttggaaagtattggtttgattcagcatttgaacactgtcatcatttctctctctcttctgtttgccatggtgttaatttcatcctaaggctggttgtacttcacgattatgatgtctgctaacaaccatgaaaggtccacgcctcttcaggccatgtcaagagatggggagaacaagttattatgaaaagctctctaagtaaaatgaggaagtgcaattccaaaaactcctagatatcatatcttcccattttatgggcccacatgggaccatgtgctcagccctgaaccaattgctgtagccaaaaaatacggtttactaatgaaaatagccctgaaccatgtacaagagttcagtcttcttctcacaaaacacatgaatttgaattggggagatgttgatctaaataataacaaagtaaggtttttataaaagtggatgctggagagacagccacagtttccactacaacaatgataatgatgacagcaaacatttcctgaaagcttctatgcatgagacccagctcacagcttaagattcctagaatggacatatctatgctcacagcatgcctccaagaaatccagccagagaatcatgagcctagcccttctgcaagccccagctgaaacaaaaacccaacccagctcaactgagtctcctctcaccccttcccttatctctaaacacacttattttactgctgtttgcttaaagcatggggcagacataattactgaattaggcaagatctggaaagaaccccaaagccatttttactcaaacagaaatcatttgttctaaggagcccacccatcacctcctgaccttggagcttaattaattttacacaagaaaagtgctgggtgcccctgacccctcctgttggagacattcccattaagaaggttactgcctccctcagcagggacccagctgaaattggctataagggctctgtaaatctggcacttgtccgggcaagaaaactgagttttctgaagcaactggagaggaaataaaaagtaagtctcacctcagccagagttgcctccttggttcagaattgccattgtcactagagttttcaaagaagccacaggaaaagcgtctgcctgggactccctgatctccacctcctttcactgagctgactccttgatccttcagtactcatcttggctgctcttccttgaggaagtcttcttgactcttccttcaaccttgcagattgtgtaggctacaaccctctgcgtttgtcacacccatggccctttttctctccaccatgcatctaacccaactgagcaaaatggcttacttacttacctatgaccccctctagatcatgggtgccttcagaataagtacagagtgtatttagggccgggcgcggtagctcacgcctgtaatcctagcactttgggaggctgaggcaggcggatcacgaggtcaggagatccagaccatcctggctaacacggtgaaaccccgtctctactaaaaacacaaaaaattagccaggcgtggtggcgggcgcctgtagtcctagctactcgcgaggctgaggcaggagaatggcgtgaacccgggaggcggagcttgcaatgagcggagatcgccccactgcactctagcctgggcaacagagccagactccgtctcaaaaaaaaaaaaaaaaaaaaagaataagaacataagaacataagaacagagtgtattcaactttcaactacatccttaacctcttagaggctcgataattaccatggaaagaaggaatagaaggggataagtaggtagacagacacccagtagatgagtgtcttgttcatcctgttctcatagctccacaggcctcatcatagaatcttcatgacgtaaacttggagctgtctgctttcctacgctgcaaaccttgatgatgatgtggtattatttctgccttccttctccagcacagaatctgagggctcaagggaatgactggcagacgaagcctgaaggggatggtgcaatttcaaaattcaactaggaaaaccagatgtcctactcttggagttacggagtgcaggtgaggaactgcctatcacccttcactgctaatgagctcttcttcccacctttcccacaaagtgaggctgaaaaaaatcttttcagccaaattcaactgcagaaacactggcttaaacaaatgtaaagtggttcctttaatggagaatttcttagaatttcagatcattgtgtgatatgaaactgcagggtatggacagaagggtagaaaattcttttatatatatatatatatatatatatatatatatatatatatatatatatataaaattagtagccaactggatattttgttgtttatttaggagtctaacattgaattactgtcatattgaatagtgtttcacaaatttatttgtggcataaaacaagtttcttaaagagatttggaggggttcttttttaattttttttcttagagacaggatctcactctgtcacccaggctcaagtatagtaatgtgatcctaattcactctaacctggaaccaggctcaagaaatcctcctgcctcagtctcctgaatagttaggatcacaggcatgtgccaccactcctggcttttcttttttttttttttttttaaatagagatggggtctcattttgttgccaagactggtcacaaactcttggcctcaagtgatcctcccacttcagcctcccaaagtgctggaattacaggcgtgggtccccatacccggccctgtttgttttttaatttagaatttgccgtggaccaacaggcagtcgtattctccacaactagtgcacagctcatgctgcatgtcatccacctcttttttctccctcaactccctctctctttctccctgtctctctctcccagagaaagagaacataactggaaagtgagctggtgcactaaagcatcaccaccatctgtccatttcccacactaggagatacctctgtattacgcagtcccatggcagaagcttctggaggaggaaacagatttcccttgccccttcagttgaagaatgaacatcaggaccagagctttgacttgccaatgactagggtggcctggtctagtggaaactgagagcctcttatttctcgggctctgcttgacaaagctatgtcaaaccaaagatgctgtgcaggtaggacctggctttggaggtgagatctctcatcatcaccatccaccagacactcttactctaatctgtcttagccatccaacagcccacctcccactgtgctggctttaagaccaaccaggaatcctttgtccatccccaactctagtgacagtgacactatgtaagagggagacaaaccaatggagtgaaataagtgtcaatcaaggaaaagagctccttgtcttgtctgggctacccacctctgagccctctggcttgcatggcttacttctcagtgagctgagacttcagctccaccagaagggttcagtttcacaaatatcttcaccaaaaaacacctcctttgctcccagaacaggaatgccccagtgccccatccatatccatgggtcagtcttaggattgaaggagcctggtttctggctgaagctctcaccaagaggattactcaggtgtaccagacatttttagtttttttaaaaaataactttaacttttattttagattcagggggtacatgtgtaggtttattacccgagtatattgtaatgatgatgaggttagggatgtgactgatcctgtcatccacatactgagcacaatacccaatagttagattttcattccttgctcccctccctgactgccccctctagttgtccctggtgtctaccattactatctttaggtccatgtgtacccaatgtttacctcccacttacaagtgagaacatgtgatatttggttttctgttcttgtgttaattcacttaggatagtgacctccagcaccatccatgttgctacaaaggacatgactttattcttttttgtggctgtgtaatattccatagtatatatgtaccacattttatttatccaatccaccatggatgggcacctaggtagattccatctctttgctgttgtgaatagtgttgcagtaaacatgtgagtgcatgtgtctatttggtagaacgatttgttttcttttgcatatatacccactaattagattactgggttgaacagcgattccgttttaagttctttgagaaatctccaaactgcttttcatagtggctgaactaatttatattcccaccaacagtgtataagcattcccttttctctgcagccctaccagtatcttttgtttttgactttgtaataatatgagctttgttttttatctgagtcagtatgcaaaagccagaatagatctttctcaccccagtcatcagtttggacatatattggaaattcagggagcaagtttctctccaggccacttttttctatatatttcctcttcttaagtgatataaggccccccacttgtgttggtgtcaagtggccaataagaataccagtaatactcatagttataggatagtaatgagttaggtacttgatatggtctggctctttgtcaccatacaaatctcatcttgaattgtaatccaaattgtaattcctatgtgtctggggaggaacctagtgggaggtaattggagcatgggggcagttcccgcatgctgttctcacgatagaaagtgagttgtcgtgagatctgatggtgttctaaggaccttgtccctctttaatctgcacttctctttcctgccaccttgtgaagaaggacatgtttgcttctccttccaccatgattgtaagtttcctgaggcctccccagccatccaaaactgtgagtcaattaaacctctttcctttataaattacccagtcttggatatttcttcatagcagtgtgaaaatgggctaatacagtactacactaagtactttgcttatataatctcatttaatccacatgtcaacctaggaggaaatagatacaagtatcctcatctcaaagatgaggaaatcaaggctcaagaaagctttagtagttgcccaaaatctgcatcactccaagttctgtactttaaatcaatgtgttatattatctctgactcctgtaatgagcctaaagagacaaggggatggaagacccagatcttcccaagggatgaaagactgaacaaagcattctgccccttacttcttctgactccccatccaaacttatttgtcagatgaaaatgggcaccgaggtcgacgttgaaaggaaaagtcatgctaaaagagagcctagtttggaaaggggtgactaagacatcaggatataaatattttcttgatgtaagcataatgtgtgaatagtgttcttaattctaagccctgaggttttttggcatcagccagactcacaaccacagcactgtcaggtagctggggtgggagagatcaatggtcagccaaagactcctgttccccttctgtatcaataaatgacagctgaagagctcttacccagctaagggactacatttctcaggctcctttgtactcatctgtggcaccaagttgtggaatgtagacagaaataatctgttctactttcaggcctattggaacctcacacactgccctcagctctctccctctttcaatataatggctagtgtcaatgcccaaatgacctaattacccatgagaagcccaccttctgccgccaattagactttatgggagtaagaaatatatttcttttatgtcacatcagtgaggttttgggttttctccgtcatggcagctagcaataccttaactagtacagagaccacaccggcttgatagacttgggctccaccacactgaaaggaccagttttctctcaagacaaaagagaccttgaggacctcagcctggacccatatctctacgggttataggctaggtccctaaccctaactcatcctatcttactctgaagccccatcttaccctctcaacaaatgtcttcctgttgtagacagcagctagcagtccctgaacccagaaaacttcctcttcagatctctgcaaggcctaaaggatctttcaattgcatgaattcaaactcactatccacacattcccctcatactcacacccattcccagcaaattgtccttcactactctaagtagaatctctattgcattaagccatatctataccttaatttaatgttttataaattgtggaatgctatctagtattgtgatggtaagttgagattaatcaaaaatttcaaaaaatgaaatagaagagaatacaaaatatcaaaatgcattgcacatagcaaaggcacattttgctttgatatcaggatataaatgttttcttgatgcaaacataatttataaaaagtgctcttatttttcttatttctcaacagatacagatacttctgtatctgttttgttatacttctgtatctatctatgtgtctgtctgtctgttaatccatgcattcacctgttggtctgtccattcatccatttattcatctatccacccattcatccatccatccatccatccatctatccatccatctatttatctatctatccacttacctacctatacacacacatatatacacacataatatatgtataataagtcacaatgtaaaatatatgtcttactaattatttcagtcaaaaacgtttgaaatctctttcctgaatgatatgtcccctcactctaataaattcaagtccttccttttaggggtttcttctttatctaagattgagtttccccaggatcattgtcagggatactacatatactttcttatatcaaatcagctgaaagctttaatgatgcatatactttcctttttctttcttttttttctttttcttttttttaatttgagatggagtctcattttgtcacccaggctggagtgcagtggcacaatctcagcccactgcaatctccgcctcccgggttcaagtgattctcctgcctcagcctcccgagtagctgggactacaggtgccaccacgcccggctaagtttttgtatttttagtagagatggggtttcaccatgttagccagaatagtctcgaaatcctgacctcgtgatctgcatgccacggcctcccaaggtgctgggattacaggtgtgagccactgcgcctagccatactttcatttttcaagccagcgcaaagctttaaataatttaaaaatgtggacatccagttcatttatgattcctaaaattttgttcttttcttctctcctctctttaaagtgtgttgcatctttatctctgtctggagaaaattggtcccagccaagttgtagggttacggcttcaaatatacacatgcttatctatataatgctgtgtgtatcccttgtgtccaaaagagtacaccccaggatgatccacgtggctaattaagagtttgactcatatatttttgataagaaaatattggggaaaagtctaaattatttataaactaggattatgtattaaaagcgaattcaatatacatgtgtatataacaaatatttattgagcaactactgtgcagcaggatgaagataaaatggtataagaagagattcctatttttcatgtaccttatggtttagttattagaaagttgttttactgccaataaatataagggagaaaaaaattcaaaattatcaaagtttttaatagggactaactcaccaatgacttcgatgtttaatgaggccaaaactcagtatttggatccctttgatgctagtatcaaggatgttgattttcttaccctcctggtaaagggaaactggatatgctgaaagctccttggcattaaaagccaagaccaaagacggtaatgaaatcatggtgcactcaagtcatcaccaacagggcagcagaggttagaggcatccaattatagggagcccctgactcatgcttcctcctggttccctgtctcagaggcagctgagaggctggtcttggaagtatatctgtacagatggttgatgtctaattaacaagggacccaataacatctttctgaaagtcccaatttgatcatattctcttccaaccagttgtatcgcttcagtggcttctcattgctattggggagaagactgaaatccttaagcagtcctacaaattcttccataatctggatgctgcctgcttggctcctgcgtcttctcctcattctctggagaattcaattgcacataccatataccttcttacattgggcatttgaacatgcatgccatctacctgaaataatctctcacttctttccttgactttgtttcatccagttaatgcactcatcttccagacagaagcctagggatcattgccttagacaagccttcctttaccttcctggactgagtcaattccccttattatttactttaatgccaccacatataacttctccatagcactttaacttaattgtaatgttatatctttgattaatatctgcctgagggtaggaataatgtgttttctattccctttcattattttctttctttcattgatgcctttgggtcctagagctgtgcctggcattgagtagattctcaatagcaggttgttgaataaatgcacgaataataatgggagtgtattgctaacatctggaacagcatagcctagcaggataggctgcctaaaatttcatttggggaggaaaactaaagacgacttcaggataagtgtctagtccactacacaaaagaaacacaacctgaaaacagatagtgaggatgaagatcactccttcttgaatgggtagagagcctcttctccaaacataaaagctacagtgacatttcctgggttccattctgggtgatgaaagggaatgtttgcagtacatggttgcttctcttaaacatattccagtaatgtcttaaggttaagagagctacaagtaggttgagagaggcaggctatattttttgaaaattagtaagagaagggtaagatcagtgataaaagatctcttacactttgaggagacccattttgctagtgacattggagtcatggtcacatgggtcccttccaggctgctatggcacaggacagctgggctgagaggctgactggaaaagcttggatttcatgagtaggttgaagagaaagacctttgtggatctcagatgggaagacaagagttcccactcatgcataataatcatagtgatattaaataccacttactgagcatctattatgtgttaggtactttaaaactttatttttaatgtttaaaacagctctgaaagttcaattttataatctctatgttacaaatatgaaaacggaggctcagactggttaagtgacttgcccagctgctaaatgatagaaccaagactcaaaagtggcttgtggttgtggccatgcttcttcactcacagaactggccctgggggctgcccatgaagacaaatgaacttttgcatagtgtccttaaatacaaataaattacatggacattgcaacctacttttcaccaggtatcaaagacctggggtacattcccaacacagtgtgctttcttcctcctcaattccctttgaagttagtgggaagtcagcacctggaggctacagagaatcacagtggggctgagtgtccatcttgattttacactgtccatatttttaataaaataatccagaatcaatctctatctatctacttatctacatatctatcttttcccaatttaatgcggtagcaccaaataattttctaattcaatgataaaaattaaactttctatatgcaaagtaggtcaaaaatagctgctttaattatttaagtaatatccaaacaggcaaacatcaaaagaagctcaagttgcaacacaaagaaagaaaaaaaatctttagaatcagcaacttttctaaggcaaacaagatgatctcagacacatgcacaagctaagtttaaggctttctctttaaaaaaaattgcaatttcattgatgataagatcattaataatactacaacatgtccacagcatattcttatcaacccagcattctggtcgtatttacatacaggctatttattgctatggggtttcaatgaggaaaaacaaattcattaaaaagcctagaaattagtaggaaggactgagatactgatgaggttccttgattctaaacatggctggctatgctaacagctcctttggaatgcttggccctctagaatatagccagaaagccaggtgagcgttttccgcactaaatgcttattccctacattctgcatcattttgtcagcataaagtctcttctctggcttccctcctttaaaatatgagcatttctatggccctagaagcccattcttaattcaaatcttttctacctaacatgtaattttttttttttctctcctcaactaaacctctctgaagcatcaggcactgtattgggcactgaggaataagaacacaaagagaacagctgttaaagatctcacagaacccaaacaactaaggcataatcaataaaataatagatgcatatccagggcttcaagaatacaggaaaactgaaagcttcacagaggatatcacatttgagcttgagtcttatgagggaaaaaataaactagaatctacaataagaaagaaggcatctctggcaccggaggcactctatgcaaaaacatagagaaatgagaatggcatgttcttgcaagaaaacgctgagatggaataaggctgtctcctaggggcggccagaaatgtaactgtacacgtatattggggcctcctacatcatctgggacttggttttatctggagggcctatgttgacaaggattaactgaccatcactccgtaaagtcttgtacagcagaaatttgggttctattctgtattatgacttactatacaactaagacaaattccttcccctctctgagaacatccactgcaaatcttaaatgcctccccagaatcgttccccagtggctcctgcctcccaaattgtgctgtcactgatgggtgggccagccactttccctgggaatgctgagccctgggcctgggccaacaagccacatgcccagagttctggctcctcctccacttccagacttagcaggaacaccaatctgccttggtggcatctggcaaacagaacaaacaccaaaaggtcaggtgacatgtcccagaaatcagggaattaactgttcgtgggctgagtcttgactaatgggaaaaaggagatggaagggagccaagcagataacatttcctctttcctgccctgcagactactccatttcttctgcagccagtccacccaggttcttcctctgaggtgacttggtctattgtgaaggagcacccatgaggacacctcatttcccattgcttcccaggattccttgccctactttcctttccttaccttctccttgttctgatctgcaccttccaagtcaaacggataagaccctcagttcttgcttcaggctctgttttctcaagagcacagcctcagcctgtttttgttttcaaaatgagagagatggccaagcaccctcaaagttacttctgggtctgagattccaaagtcttagttctaacgttcaacagaaccttgaccaagacttttcacaggccgggcgcggtgtctcacacctgtaatcccagcactttgggaggctgaggcaggcggatcacgaggtcaggagatggagaccatcctggctaacacggtgaaaccccatctctactaaaaatacaaaaaattagctgggcgtggttgcgggcgcctgtagtcccagctactctggaggctgaggcaagagaatggcgtgaacccgggaggcggagcttgcagtgagccaagatagcgccactgcactctggcctaggcgaaagagcgggactctgtctcaaaaaaagagaaaaagagttttcacaaagcaggcaactcatgtccatcatgaagtatgcaagtcggggcaccactttctgcattgggaaatatttctaagaggtttctagaatcacccccactttacatatgggggaactgaggctcagaaagtttaactcacttgcccaatgccatgtaactaaaaagaaccaaaattcagactcagacagtctgattcctgagcttgtgttctttgtcactactgaacactgtgtctcttagactcttctggatttactcttcaaacctgattaaattttccatttcttaaagactagaaaaaaattcaaaatggaattatgggatagaaaagcaaaatgacatctcctgggctgcaccaaaaatacaagggagaagggcaagaatagtatgccgtatcatttaaggagccaaggtcatatattcaacaaccagttggttgtcccacattttagcattctttcccttaacttttccttgtaagagaaatctgtaaggcagaaaaacattcttagtaagaaaaaaataaaaccctgatttgggttatgaaaatgtagctgctgtaaacccaaagaaaacatgtcagttcaactccacctaagatcgttttatgccccagtataaattctaacatgagcttcaggagtggtatgtgaatcttgtttttgttgttgttttttcttttttctttctttttcttttttcagattcatgggtctcttgaagagctagtcatcctagcctattaataattttaatcttaatttctttcccacttctcctactctctccaataatgaaaaaaataagaccttagccatttgtttcccaaaaacatggagcctgtttcatgactattgggagcagatgttaacatacatcccccaggagtcagtgcaggtttgaaaccataacaggagcagacaacttacctccagcaaggctattaggtacaaggggtcagagagatacaaaacaggtattcccactggccaccctgtccctgaaatgcctcgccttccgtctacaaccccagccttccacagggctcatcatccttcacgaatgacccccaatcttctccaagtaaatgatttgagtttctctcatactttctcagtgcatgtgacagtttaagggaggttaccaagaaaaattcttccatacccaagacaattctcccactcacacttccatacaagcacacaaatgacctcatggtttttgaggaaggtcagctcatgtttcggagtctaataatgcctaaagcaagagcaaggaggggtgttgtggctgtcagaggcatgggaaaccacagcttgttcaggaatcctcaaagggcatgtgctggagcttttcaggattgaggaccagaatccacatggtcgaagacaatctcaattttgtatatctttgtagctttagggttttgaacactttagcttcccaggaagatacatgagaggaaaggttcgcaacaagtattgaatgaattaatgtatgaaatgaatgaattcaattgtttccccatccatgataagtacaaattacttcttcctcgaagacaacctgatgttgatgtttttgaggtcaggcagcccctttgtcatttacaaacaacagactttaatctcctcgagcttgttttccttaccggcacaaagagcattatagtctctatctcaaagaaccttgtgaatattgaaggggctctatacatataactacctgacacacagaggtgcttagtagttgctagtttactttccctctttgccttctccatgttatctgaattccctagtccataatcctggttccaccaagccaaggtcagtgccttggggtcctgtgccagtttctgaccaggaaacactataccatagagtcctccagatcgcaggctctgaaagccaacttttttcacttgaataccagctctatccttactagctgtgtaactttgggtaagttacttcacctctctgaatacctgcttcttctccatctttcagatggggacaataatagtacttactttgaaaggattttgtggacacatgtagagtttagaatcatgtctgagctgagaactgctcaaaaagtgtaactggtattatgacgtctatataagtctactctacgtgaaatgtgaacttctcaagccaagaaccaaggtttcaatccctcaggcccacagcagatattttgtcatctagcctgactctctaggcactttctgctatttgagcaaaggctagcttgctctccttaccctgtactgcccaccatctcatctttccaaacctcagagaacttgggaactttctgagcaggcccaggagtttgggaagtgcagcatctttggagcacatagcaagcctctgaggcccctcttcagaatcccaggcctttgggaagcacacagtgaggccttcctgcaacacactctcctcctgttaatgaaacccttagtttgggtcaagtttcatgtggaattcatgacatttttagcttcatgacaatgcctgaacctcacctccaccccaccccatttttctgtgtgtgtggttttttttttggtgaatgggtgcatgaagggcacaataaggtttattaagtaagagacagaaatgcttgcaaacctttactgctcctcccaggcccataaacagttcctcaatccttctttgcaaggtaataaaacctggtgggaggtgaactctgggacccatggggtaagggtgggtttgcttccagcctgaggctgaaccccagggtgagcccatgcagcctccttccctgctccatcctcaatgggagggaagtaaagggagaacccatagagctgagctgctggaaacccaaaaagcctgcaccccctcagattgcctgtaaaaagcagagaagtgcagatctcagagaggctagaagcagcctggggacccaagaggaacctcgggaaactctgcagtcagaggcccttcatgaggaaaaaggcagtacagagcagaggagagatcacagaaaatgagccagagtgctgtgttctgatgtgtgctctgatgcttactggttaaggggccctgagcgagttccctgacctctctcatcccgtttcctcatctgcacatgggaataatgagatactgggatgtatgcatgaggtcatcaatgcaaagcaactcacactctgccaagaaggacccaggagaatggcatggcaaatcattacttaaagagtgggttcaacacacaaggcctgaaggattattgacatgaagctatgtggagttaacgatagcaaccagagaagttacccgccacatgtatgttttggtgataggcttgccatcttctcagagagcccagaagaaggcataaccaggaaaagccctcaaggatattggcagacatcaggggtgctaagaagatgggccagaatctctccaggggttggcacctgaggagtccacctgtcattgcactaccagcttcctcttctggcttgtgcgcagaatcaggtggccctgattttgcccagtgatcatcccaagcccagagccagcagtgcctggacctgggctaggatggacttgtgacctgtaaccctgtggcatgcaagacagcatatgatgatgcactgtagcaaggagggatatagagatccatgtctgggctcaaaaacacattggcacaaatagaaaatgggaattgcgttttaagagtcacactcataggccaggcgtggtggctcatgcctataatcccagcactttgggaggccgagccaggcagatcacgaggtgaggaggtggagacaatccgggctaacacagtgaaaccccgtctgtactgaaaaatacaaaaaattagccggcgtggtggcacacacctgtagtcccagctactcagaaggctgaggcaggagaatcacttgaacccggaaggcagaggttgcagtgagccatgatcgtgccactgcactccagcctgggcgacagagagagactctgtctcaaaaaaaataaaaaagagtcacactcatagtaaagtgtcaaggcttctagtcatcagttatgtcttttatgacacttgactgagttaggttttttaccttcaatcagttaaatttccatttgtaaggcatgttaacaaaaccacatttcatttcaaacattcaagggattctctaatagatcactggtgtcttccttttggaaaagttacaagaatgtgcactccgcccagttgaaagatgaagctaaaaccagaactaaaaattgatgaaaaaagtccgctagggagcactgaaatcaattaaaatacaggtaagattaaatcgttattttaatctttgtaataaaatcatgtgccagagtcaatattttggagaaagtcagtatttaaagtaaataacaacaaaacaacagcagcaatgctaattatataccaatattttgtatctaaaattacagaacctgttaaaatactgcaacatggaagaggaaaatggtagagaagaaagtaaaagtatgataaaattcttaagcaggaagagctgagtttaatgctggatacataaattataaaacaataataataataaagaatataaaggtattaaaaacaccccacaaaaagcaagaaacccaaggaaaagataaggacatgttaaaataaatttttaatcaaggtgatagaagagtgaacataagagttataattttagatatatctgtaaaatatctgaaaaaaagattctttaatcagaatcaaaacttaaacagtcctcaaaatttttgaaactgaattatcagttaaaataaaattaagaagtaaataatagtcacactacttgtatcagacaacagattaacttggatagaaaaacccactttcaaatagtaaaaccccaatccacaaagaaaaaatgagaaaaagatgcaaggaataataataacaaaaagttaagtgttcatctctcagtttttaaattatagaagattttattttcttcatttggtttatctgcattttctacattttcttcagtgtacacagcagaaaaagagttataactttccctttattaccctctccatttccaaataagcaaatgcaactcaggtgtcatctcttcctggaaaagcccctgacattacaaccccactcctaaatgagccctgtgaggtacccttctcagggatgtgccaagccagcccccataaactagagagcagggtatgcacacctcttcccagctccatgtgcagccacgtcaggttagtagcttgaaatctgccagggtggaagcatttacaccatgggaatcagtagatgctacaaatcaagatctctcccacctacagccggttaaatatttattagcacatcactgtttgtgtttctagaaatctgtgcatgtccttccataatttttatcatcttgcactacagcgtttaacttgcttttttctaccacaaattcatgaacacctaagaggcaggacatttcctatgttatctctcacccacaccacggcacctagcacatagctggtggaaggaaagagagaaaagagggaagggagggagaagccaaagaagggagggagagagagataaggtaactgctttcttccttcaaatgtaataaaattggctaattatttataagtatcaaccacagcccattctttggagcatgaaatttttccaactatcaccaagagaaagatctaggtttgcttgctcctgatttctaagaagaagagggctttgcaaagcagccccttacctctggaacttccagccagactagaaggtagaatggggctattattgaaaagacattcctgaatacaaattagcatagcaaatccaagttttgcttaggacatttcctggagattaacaattttcaatctgtttcctcattcagcacatgggaaacatgagaactctcccctcactataccttctgtcatttcatcgaggaccaagtattcagaaagggcaccataaccataaagtacttgaaaagtgtacctatttggttcctcctcactttcaaaatgtattggaatctctttcctgaaaacaaacaaaaaaaatcattttgctattataccctaataggtatctttttggtagtagcttgttcatgcttattaagattaggtattataatatcgtcattaatataaactcctcttctccatgaatatgtagacccataacagaagaagcaacagaggccaaaatcctcatgaaattaaacaaagcaaaccataaaacagtgggaagctcaaccggcttagccagtttttctgatacatactagatataaccactgagctgttatttccattgtcctattcaagttccttcaggttatgtgtgccagtatgtgtgtatggcagcactgcatagaggagagaaggaaatggaaaccactaattattgagtagctactggactcactcactggctcaacaaatattgactgagcgatgtgccagcactggctcagcccctggggatacaagtgaatgagacaaacttttagagtatgcaatccattggagaaatggggcagagccgtaataagaaacacataaacaacataattacagattttaaaagttctagtaagaagtgaaacaaagtgttgtgatgcactgtaaagggagagggatgtagtatttaggaggaacaggagagagttctctaaagaggtgacatataagccaatacatcaattaaaggataacaagaagttggttaagcaaaggtccaagagagaagcattcccagcaaaggaaacagcagaggcaaagaccttaaggtacaaaagaactgagcacatgcaaagatcataaacgaggtcagtatggctagagaggctgagcaagaatgagtgtgggaaataaagttagagaggcattcaagtactaaacatataggacattataaagagtttagatttaaatgtaagtgcaattgaagcatttgaagcagcaaagagatatgggctgggttcaataaaagttttcatctgtatattatatgaagagtggagtagagggtgcttggataagagctgggagaccaattgaactgctgcatggacttcctttcatcatattctgggatttggaggcaaaaaaaagaatttagtgcatgttcactgaatccactgtaaagttttcaaatttgaatccatttgtccaaaggaaacattcagtatcttcacgcctttctcatatgtctggctgtgaaatcttgggcaaattacatcacctctcagaacctcagtgtcttcatttgtaaaagtagtttagctgaatcttccagagtatccagtaaatgttatactccttaatttcttggaaaggaaaatgactcagatctactggaaatagaccaggtagctccaggcagttccctgggccaggacacagccaagcttgggtggagcctcaaaggggccagggtggagaccaagagaggcctagatacctgattatgcatgcaaagtcccacatcctagacacaaaccttcagctcaggaatgtggcttaggcggggcttgctagcaatggaaacagcagagagaaaaccaggaggcactagaagaaaaaaacaaattaatatttaaataattgtaggttggagagatgttgctaaattagcaagcaaaggcagaaagcatgaaggcaaagattgatagaatttatttcatgaaacatccaaggctatcttagaaatcaaaaataaaatcatgaataacccaattaaaaatgggcaaaagacatgaacaggtatttcctaaaagactgagtgtttctgttactctggagaacccagactaacgcataaacaacaaaacagtgtgttagaaccaaggatcatgattaatcaattctgcgtacctgagatctgaacaagaagaaaaaataagaaagaggaaaagataaacccttgcaaattgttaaacagtgttagtaatcaggaaaatacaattcaggacaactatgatctacaattttacacaccctcaactggcaaaaattgaaagtttacaatactaaattatggagaggatttaggtctacagaatttcttacacactgctggtggagcatgacatggtattaccactttggaaaataattgagtagtgtcttctaatagtaaacatttttattgtctatgacctagcaactctactcctggatgcaataatacacatatatcaagacacatagccgggaatgtttagagctacaatgtttacagtagcaaaaccctagaaaccactcaaatatccattaatagatattcacaaatgacagacgcatgatatataatatgtaaaaatggtatatttagccaggtgcagtggcattatacctgttttcccagcactttgggagaccaaggcaggcagatcatttgagatcaagagttagagaccggactggccaacacagtgaaactccatctctactaaaactacaaaaaaaattagctgggtgtggtggtgcacacatgtcatcctagatactatggaggctgaggcaggagaatcatatgaacccaggagacagaggttgcagtgagctgagattgcaccaatgcactccagcctgggtgacaaagtgagactccatctccaaaacaaacaaacaaaaaggctatctttatatattatatatcacgcatctgtcaaaatgaattaagcacaatgatgttacaagtaaccaagtgataaattttagcaaaattacattaaatgaaaagactaccaaagattgctcacaagttctttaagttactgggaaagttatatatttttatatcacaagtagttatatgggttttatgtaagtaaaaattcattgaactgcatacataatgttttgtatatgttatttgtatgtacattataaatcaattctagttgttttttaacgaattgcatacccttttttggggggtctggggtgatggagtctcactctgcggccagcctggagtgcagtggtgcgatctcggctcacttcaacttccacctcccgagttcaagcagttctcctgcctcagcctctcgaatagctgggactacaggtgtgcaccaccacgcctagctaattgctgtatttttagtagagacggggtttcaccatgttggcccgggtggtcttgatctcttgacctcgtgatccacctgcctcagcctcccaaagtgctgggattacagtcatgagccaccgcgcccagctgccttttttatgaagctacaaaccacaatttttaaaacctatcttgtaatactaaactccacttctatttaataaaactaaataaaaatgaattcaggatgataatgacctcagaagagagaaggtgagaatggattgaagggggaggaccaaccatgtttatatatggcttcttgtgaagagactagctgaattggggaaggaacttcacagatgtctatttaataatgtaataacattattaaaattgctaaattaaacaaaattacaaacacaggcaaaacaactaaataaaaggaggctgtgatagttaattaggaagctgtgatagttaattttatgtgtcaatttgaccaggccatgggatgcccagatattttgttaaatattacttctgggtatgtctgtgatggtgtttctggacgagattaacatttgaattagtaggctgtaaagaagatcaccgccctcaatgctcaatgttaggtagacctcatctaattcgttgaaggcctgaataaagtttgtgtaagaaagtattttccctgtgcctgcctgacctcaagcaaagacattagtgttctaccttcagacccagactgaaccacatcatcagctctcctgggtcatcagcttaccagctgcagatcctaggacttctcagcctgcataattttttgagccaatttcttattttagatagatagatagatagatagataaaatagatagatagatcaatagatagaaaaatggaaatatatgtatcttaataaatatagagagagatagatggatatataggctatatagataggcataaatagacatgaagatagatgcaaagatacacacagatatatgtgtgtgtatttgtatatatatgtgtgtatatgtgtgtgtatgtatatttacataaacacaaccacaaacatatcctattatttttatttctctggagatcccagactaatacgaagaccatgtatgaacaacaaaactatgtgttagaaccagggattataattaatcaactctgtgtacctgagttctgaaaaaaaataacaagaaagaaaaaaagatacgttttactatgggaaacaaaaacagaataaaaattctaaatcaagtgataaacgtagaagaaacattttggtatctatacatgtcacagaaaaaaagttaatactttgaacatataatgaggaattccaaattgaaaaggaaaaagcaaacccttcaattgataaaatgtgtaatacacttgatcagaatttttttaagtaaaatgtaaaaggcaaagagaaaatgttaaagtttacttagaaacagaacaaaaataccttttttacatatatctgaatatcaggagccagatttttcattattatagaagtttacaaatataaaaatgaaaatattagtgtttgtacacctaaaaggcctctatacccacagtattcagatcttggtttctaaatactattctcctttaaagtattgaggacttgttggaaaataggcagactccagggatgaagcagaaaaaaaatagaagataactctgaaacatcatgttgcatcaggaaagaagaaagtgttcaaagaatgatagggacatatcacaaagatatggacgccagcttgaagagactcccactagcaacatctaggacaatttgagcaccaaaaatggatgataatccagtcaataaaataagaatctaggagtctgtgataatgtaaataatcaattaatcaatttgaatgaagaagaaagtcttccttacagaatattgccaacttataaatgtaagaagaacaataaagttagaaaattattgataaatgctagatctaggggttgaatgtttgatgagaaacagtgtattgtatagtctcaaataatttacctacaaagggaacaccagtggaaaaccagtaaacttataatggagaatcagacagatacctactgaaccaagtgatcaaaattaatacctctaaaaatggacaaataaatatcatcacaacattactcctttagtttttctgccaaaaaatgcataatctgagtcaaccatgaagaaacatcagacaaacccaattttagggacattctaccaaatatctgacttctacccttcataaatatcaaggtcaagaaaggcaaataaacagtttcaaaataaaaaagaccaaagagacatgacaattaatgcagtgtgtgattcaagattaaatcttggaggggaaaaaaacaaatcattaaaaagaatattagacaattgatgaaatatgagtatggactgtaggttagataacagtattgtattaatgttaatggttaggtaagaggagtgttttgtacgttctcaagtatttagtacaggggcacactgtttctaaattttgtttcatacaattcaggaaaaatttatataaataagatagagttagaaatatcagtgttatgtgtagaaagagacaggcatgtataatgattatacacacatacatgtacaacaagtgaagacaaatgtgaaaaggaagcattgatgaatctatataaaagatattcaagtgttccttatactcttattgcaaaataaacagttgctttacaatatttacatacacatatatataaacagctatactctaagtaggtgggaattcaaggaagtaggtactataatatactgccagtggggaacacgtaagtgggtattacttttctaaatgtggacagttggcaatataaatcaaaaccaataactttgacatggcaaaatagaattatggagatggatgtgcataaatccagagctacaattctcataatactggaaatctaggaagtctagagataacacaaatgaccaataagaggaaaccaagtgaacaaattgtggaacatccatttagtggaataaggatacaatccttaaaagttttagtgcagaaagctattttattacataggaatttttatacactatattaagtgaaaaaagctagtagtaaaaaagaaggatgtgtaatttgaaccaattgtgcaaaaaaaaatacatattaaggtagaagacattattggccctagttcttgactcctttctggatctacatcctttgccattgactttggagttagtaatgggccttgctttgaccaacagaatggggctgaaatgtgtgtgcaccagtcccaaccctaggtcataagtgccctcacacattcccactcattctcctgcatttctgcccatctccatgagaagaatataactggactggtggctttcattcccaggaggaaaatgagagccccttggagtagagcagatctacacagccaagtccagcctaggtcagttaacccctagctgccccttagattcatgagattaagtgactgctgcattaaggcctgagatgaagatggcagcattttctggaaatagctgattgctgtatacctgaggtacacacctcaaaggctttttaagggctacctctgggttgcattattacagattatttctattttctttttatatggtttatctatattttccaaatatttgaactgcatatgtattgttcttggactttttttaaaaatgacctacaaaatgatgacaaaagtaattctaatgagctcaagttcagtggatctcaaaggattcctggaaaatgagtttcaacactcaaagaaatagatagcttcaatttattaaatgtccattataacccaggcactttaataagcgcaccctctttttttggagggggttgcttcactatccacaaagcaaaaaagttatataagatgatttccattttagaattgagaaaactgtgaacatataagttgagtcagatgcctgaagttactcaactataaagtttcagagctggaattcaaacacaggtgtgcctaatgtgaattcaccatccctgattgatacagagacctctcttttccctgatccagacagaattctgctgttgagcttaataactcagccctctatggggtcctgaatgtgcagcattgctctgttactgtgaaattacccacactatacacccacctcccataaggtgggatagtaggttaagaaagctgcaaattctttgccacttttcccattcataggtggaatctaattctcctgcctttgaatgtgagctggccttagtgacttgctttaccaacagaatgctgcagaaatgaagacctgggcttctgtgatgtcctaaaaagattttgagcttccacttgaccacttggaaccccatcccctaactctgaggaagtccaagccaccctttgaagaagcccacatgaagagaattgagtcccccagcagacagcccctgatcagcttccagcaccaaagtgtcagtcctgtgagtgaaccatcttggaagtgaatacttcagccccagccccagttaagctgcccccagctcatatcatgaagcagagaggaactgactcaccaggccttgcctcaattgctgatgcatgagcaaaatgaaaaattactgttgtttgaagccattgagtttggtatagtttgttgtgtagcaatatatgactgaaatagtatcctttttttaagtgatgaaggtagggaggaacaaaggaaaggggggagggaaagaggaagggaggaagggaagaagtatttgtcacatcatttcatggagaaaattgcataaataagtaaaattcttagtaagcaaatgcaccctgactcctgagcctcagtgaagggtgcagttctagctcagcatcaggctcctctgaggctgctctccttgtcagcaaaatcagattggtaaagagcctgaagttactgatgcaaacctgcatttcttcaggcaactgcaaaagcaatgtccacagtagagaggcaaaagctatgtttatgcactttcctgtgtatttatttatcctggcacaggaattttcaaacttgtcattttaaacccaaggaatttttcatccattttggaatttcaatcaccatgttactgaataaaggagatgatgtagggacagccaagctcttctgagtggcacaaatctagtccctggtgacctgctgccaaaaagcattcaaccaaaggaagctagaccctggccatgaagtggcattcttgtgcaagatgcttatctgaatggcggcatgcttcttgcccttgaattgtgattaaatcttgatagaatagactcttctctcggggtctctaatttctagagtggtaaacagcacctaaaagtccatctggtccagacacctgactctaggctgagaaataaataaatgctccaggacaacttgtataccagtcatttgcccatttgttctcagatctcagacccttcctctgctcagctctatattgtatatggctgagttcttaaaattacattccccaaatctctcaaaactggcttatgattagggatggcccaccctaatcagaggtactggtggaagactgaagaagaggaggaagggagaagccagagtatcttccccatcattctttgacttaggccagtgactggaactctcctggctcccattggtgcaggatggatttagctcccaggctcccaggctctgttagctccacctcctcccctctgcacacacatcccaagtttaagctattgatttcttactcctgatgttctggtgccaataatcatgtttctaccactgatttcttagcttcttctactccagattaaatgtttccaattccatcccatactttaaagctgctgaggtatcttacaggataaagaaatcctcatcagtctaccctccttcaacctggtacaattatggatccttcttatccatgagcccagctcgtccagaatctcatgaggtcatcagggcttggatctgagttctttcagttagtatgtacttagctctcaaaatgctccattttagagttaagtcttcttctgtgggtaagcaactccaggtcaacttacataagtccctgaaagttttggactgtgctgtgtatgtatttttattggcagcaccctgccaccatcaggcatagaaggaaagccccggtcccattcactcttccccctcccaaccattcatccatccaaccatttatccacctttccttcattccatccaaccatccatccatccatccattcatccatccatccatccattcatccatccaacccctcactgattcaaaggatcttatagattaagtttagagatttgggaaatagaatgaatgtgaactaaaatacacttcaccactttttacttaactgtgtggtcttggcaaattatttacatttctgagtcttagtgtgcccattttacagaatatgaactaagaatgaaataaatcatttagctactccaagccccagttttctactctgtaaaatgggatcagtaatgatacctacccattggtggatattgtgaggaataagtcagacagtccctataaagtgcctaacatatgaccttgaacatagcgaacagcaagtaagtgtttgttgtgatgatgatgatgatgatgatgatgatgatgatgatgttgaagaggaggagaaggaggaggggaaggacaaggaggaggagaaggatggagatggaagaggagaacaaggagaagaaggaaaaaaggaggaagaggaggcaaggaagatgatgctattcccagaagcaattcacaggtccctccacctggaagtgagtccatataaactttgaaaattcctatgaagtattctgtccatctcctgtggtccaagcaatgccaaaggcccatatggatcagaatccatgaggatagacatggagaccaaagtcacatgaagttgaacaagtcactgacggaccaccagtagaggatgccaaccctctgtatatgagtgccaaaatatagccctctcagaatctcagccctctctgtgaaaaggcaaagctaccacaggccagacccaacttacggtaacacaggaagactggattagatcatgtctacaaagcactttggactccttggaggacagtggtctataaatagcaggtggtggtattattattaatcaggccaaccttttattgaagctaattgctactgatgccaatgagacatttatctgggtatagccaaagaatcagactctacagcagtgatccattatttattcatcattagattagcggccaaaaaagaaatgcatcttataaaaagcaatagtatttattgtctacaagaagcccaaaagagaaaaaaatatcatctgtttttctggtcataaagacttcggtcccaatgccactcctggctgtgactgggtacatgataataagatgaattccttaacatttctgagccttcatttcctctacttcaggggttgtgaagatgaaattaggtgatgaatacttgtcccaagcccactgccaggtgtgaggtaaaggcgtggtagcttccaaggcccattactttttttttttttctttttttttttttttttgagatggagtctcactctgtcgccaggctggagtgcagtggcacaatctcggcccactgcaacctctgcctcccaggttcaagcggttctcctgcctcagcctcccgactagctgggactacaggcgcccatgaccacgcccagctcatgtttcgtatttttagtagagacggggcttcaccgtgttagccaggatggtctcgacctcctgacctcgtgatccgcctgcctcagcctcccaaagtgctgggattacaggcgtgcaacaccgcgcccggccctaagacccatttctaatgcttagggctcatcatttgttaccgtaaactaaactgtcttgtccacaccatcctttgcctcatgaagtctgggcttttattaccaagaaaatgcgtccagtttgggggccaaagaaagagcagggagatatgtcaacagaaatccaaggtaaggtatgcattatgccacgaggccttactcttctttgaataaggttgactctccactccctaattccctgtccagctatgactccaaccaatgaagaattactgtggccaatgccatacttttctgctgcctgaagtctagccaatagctgccctcctcacccatctcttgcttgctggtgattggagggggaaaaaaatggctcacatgtttgaactgaccaatgagtgagagacaaaagccacaatgatagactggcttctaggtctgcataaaccataaaggtgctcccaaataaacactgttgacccaccgtctgtgaagaatcatgggttaccatatcaccacattgtttgacaatctccctggggctcagcagagaatagctgaccaaaaaataaataaataaataaaagaagaagaagaagacggagtcaagatcagcctgggcaacatagcgagacttcacctctatgaaatgtaaaaaaaaaaaaaaaaaaaaaaaaatagccaggcacggtggcacacacctgtagttccagatacttgggaggctgaggcaggaggatcacttgagcccagaaatttgaggttgcagtgagctgtgattgcaccaatggactccagcctggatgacagagcaagaccatgtctcttaaaaaaagaagaaagagaagtaagaggaggggaaggaggaggcagagcaggagaaggtaaaggaaaagaaaagagaaaaacaagaaagtgtcggttttctgctaacaaaagctttaaatttagtgacttaaaaatacgtatctaatatcttacagttctgtaggttagaagtctaacacagatatcactgggctgaaactcaagtgtcagcaaggctgtgctcttttctagaagctttatgtgagaatccatttccttctcttttccagcttctagaggccacccacatgccttgactcattaactccttccgtcttcaaagccagcaacatcacatctttctgaatcctcttccctcgacatatctctttctgatcacagccaggaaagtttctccatttttaagtgttcatttgatcatactgggctcatgaagacattctagggtaatctcattttaaagtcaactgattagcaagtttaactgcatctgtaactttaatcttattttgccaaataaggtaacatttttacaagtcctaggattaggatgtggggcctctctacggagcattactccaactaccacaatcactaaccatttgcctctaaattgtggtccctgggctatttttcctctgaattaccagggtaaggttgatgagtgtggagattcaaaggccacatccaagaccttccgaatctaatttttttttttttttgagacggagttttgctcttgtcacctaggctagagtgcagtggtgtgagcttggctcacctccacctcctgggcttaagtgattctcctgtctcagcctctcgagtagcttggattacaggtgactgccaccatggcaggctaatatttgtatttttagtagagacgggggtgtcatcatgttggccaggctggtctttaactcctgacctcaggtgatctgcccatcttggcctcccaaagtgctgggattacaggtgtgagccaccacacctggctaagaatctgactctttagggatgggtctgggcatggtagaggtcaacaagttccccaggtattttctatgaacactcaagtctgagaacctcttcaaaacagtcctccaacaaggccattatcttccattgacaaattaagaagttgctgcatttgtgtttgctttgtttgaagttgtttctctaatcaattgatgaggttgcttgtaattagaacaaaagattccaattttagatagagtgtctaatagtgtatcaagtaactaaagtatgtactctgaagaagcgggcaccaattttagttcaaaaaaattccatctataatcactaaagaatctctgttatttgtgcttctttatacatcgatcatttatcaaaacctttttctggggtaaatcctgtgcttgctgttaagatacttaggtcaatttgtagcctgttaagtaaagggctcaaactttactaaatgaacccacatggcattggtctgagtctttgagactctaatctaaaaagagttctgttggtttctttccttgatctagtgtcagtccatttagaacattaaggggtactccactcctagaaatgaagtgtcctgtgtgcccagtcccccctgactggtttccctgacagtaactgaaatactaggacattagactaagggcacaaggtggacacacaatactgcatctccagcctgtggctcccccacactctcaaggctaaagtttacttcttgcccattcatgactactgtgtatggaagagggatacaaaaaaaaaaggcacaaaaaatctaacacatggacatatgagggggaacaacagacactggggcctgtcaggatggggtaggtcgtgggggaaggaagagcatcaggaacaatagctaatggatgttgggcttaatacctagatgatgggctgatctgtgcaccaaaccaccatggcacccatttagctaggtaactaacctgaacatcccggacatgtacccctgaacttaaaataaaagttgaagaaaaaaaaacaatctaactgttctggctctttacatatattacttcatttagtcttcacaattctggaaagtgaacttgactatgtaaatttacccatggaaaaacaggggatcagagaagcaatcccttgcccatcaatggcgcttaaaagtggcccatctgggattcagttaaaaatgtctctccttctcttggtggtgggatgtgctctggaaagtgcctgaagtctgtcagtcattcaagctctactctaactaggtttgtgaaaaacagaagtagagcttacacccattgaccagagtattgggaagggtaagatgctttattgggatatctctattgaggggatataattctttacttcccttttataacaaagaactggcttaatcagaaaacagtgtgaaattctgcatgcttatgcaactctcagcacttcgggatatgcacagtcaaggaattcaatggtaaaaatataggtgggtgacagaccatcaattaattaatcaattgaaataattttcaaaataaaatatggagtatctaccatttgccaagcactgagctcagagtctagggttgagtggttgcctcagtctgatttgcaatgctataaaagaatacccaaaagtaggtaatttataaagaaaagaggtatatttggctcacaattctacaggctgtacaaaaagcatggcaccagcatctgcttctggtaggggactcaagaagcttccaatcatggtgaaagggcaagggagccagtttgtcataaggaaagacaggaaggaagaagacaggggaggggtgccaggctcttttaaacaaccagctctcttgtgaactaatgttgtaggaactcattagcatggggagggcaccaagccattcatgagggatctgccccatgaccccaaaaccttccactatgccttaccccaaacattggggattcaatctcagcatgagatttggagggaataaatatccaaattatatcagtgatcctcaaacaattatttgtttgagctatatgacgttgccaatatttgaccacctcacctatagaaatggcatttcatatagttcaacctgtaattacacaataaactatattaaaattgtgattagagctatgaacactctaaaacaagaggaaagaggccgggcatggtggcttacgcctataattccggcactttgggaggccaaggtgggtggatcacctgaggtcaggagttcaagaccagcctgactgatatagtggaaccccatctctactaaaatttaaaaaaaaaaaaaagcctggcatgtggtggcaggtgcctgtaatctcagctacttgggaggctgagacaggagaattgcttgaacccaggaggcagaggttgcattgagccaagatcatgccattgcagtccaacctaagaaacaaaagcgaaactctgtcaaaaaaaaacaaacaaaaaaaaaacaaacaaaaaaacaaaacaaacaagaaagaaagaaagaaagaaaaaactgacagagaagctgtttgtctggagcacaagacatgatagaggttggctcaagatgcatccatagcagagggcagggagatcaggcaggatctggcagaccaaggtaaagattttggatttaatcctgacataaagctgttaaagaaaatttccccaacattttgttatattttcaaaacatagaaaaaagttaaaagagttacacaatgaactcccaaatactcactctacctggattttacaactaacattttgctattatctgtcaagtcttccatctgtccatctatccacttatcttattttttgatccattttatagtaagtggcagtcataagtacattttaccccaaactctgcagcatgcgtgtcattaactatgtaatgttagtgacattacatagttaaagaacttaaagttccatatttgtacagtttgttaaggaacatgtgcatgacagaaagtcacaaattttaggtgtcttattcaatgagcattaaaagattttttttaaccagaggtgtaacttggctccagcttttgggtaattaatgtctggggatcatggggagatgggattgatgaaagaaatcagttgaggggctataaaactagtttagagggagaagatggtaagaaaatccagtggtggccattgggacagaaagaagaggatggatttaaaagatgttttagaggtaaaacagacagaccttgatgatgaatttgatttgggttgatgaggaacaggcagggtcaggtcgacttttggtttctgggtggatagtctgagatgagccagactttggtaatgggattgagaggagagtcatgagtgcaagtttggacatggaccctcaggtgcagactttagttagttagaaaacaactaaggccgggcagggtggctcatgcctgtaatcccagcactttgggaagccgaggtgagcagatcacttgagcccaggagttggagaccagcctgggcaacacagcgaaaccccatctctacaaaaaatacaaaaattagctgggcgtggtggcatgcacctgtagtcccagctactcaggaagctgaggtgggaggatcacctgatcccaggaatttgaggcttcagtgagccatgatgacgccatcacactccagcctaggcaagagagtgaaaccctgtctcaaaagaagaaagaaagaaagaaaaaaaaaaaaagaaacaaagaaaagaaaataactaacactgaactgcatgtggagttccccttgcccctcccatccttcatccttctctggattccacccttagttagcaaccaacttttccatatgcacacctaggggaccagaatacagagtgctgactcaccgtctgaggtcactaagcagctattttgggaacatctggaggctttgtctttccattttcagaaggaaaactgtaaacccaagaagccttagtggaggccagggcgcacatgctgggcaaactggctagagtgctcctgggcttcaggcaggtcctgaaatgtcaagcccactcctttctgtcacctagagcatccccaggggaatgtccagttaccggactctcacactcttcccattaggtcatctctaatgccaaaggggtgcctgacaaaaagacctcattggctactaggtgcttccaacttagccatcgttggaggattgtgggtttgaactggcggtccagacagaaactggctgacacccacagggaatgcattgttgccccatctcaggctttgagttccttgaggacatggatcactcatctccataccccacaaatgggcaggaaatgattgaggaaggaagaatgaagagaagatatcccactcatcagacatttgttatattccaggcaccaaactgagcacaggaacaaaaagatgcattagacacagaccttacctagttgcagagacaggaatgggagataagcatgaaaagggtatgcaaaacgcagaaagacaacaaacatctacaagatcaggaataaggttcccaggacaggtgacatttgaggtgggttttgacagaggacctgatagaactcaggcaaagggaggaatagaaactgcaacacagtggggtggaaaagaaagaggctgtgggttcacatcccagctctgcctttttatgttgggcaaatgaggtctttcgaaggaggttgctaactccagtctcataccggctgctgtaagcatgcagtaagataatatatgctctgggcagatcataataaaagctcatctttattgagttcttactggcttgtaccagaaactttctataattttctcatttattgcttacaacaccaagtatttgtcatatggggtatgatcttgtaaattaattcatttttcatgggaggaaactgagttaaggagatgagctaatttggtagaaatagtactttagccaggcaggatgatggcagaaacaaaatgattaaaggttatgttatagccccttcttgtcctcagagactcttcattgtttgtggatcttggacctttatgagaatcaatttctcccccagacaaacaaacaaaaaaatgcttattcattttgtttgtaaactcagggagtttttggaacccccaaagtctgttcacagactccacgtttataacccctctgacaccaaaccacccggccacactgtgcagaactcacttactccatgtggccaaggtgggaggagaaaaaaaaccagaagagcggctcagggaagatgcctccaccttgcccagactagtggcagttggaggctgccatagggggaaagcaggcactgagcaccctgccctggggaggaggaggaggatgcatcaatgacacaacagtcagggtaaggtgggatggccccgagccagagcggcacctcctaggcaccccgagcatcgctctgagtcagggtggcagtcactgaggccatcgttgcctgccaggaaagcacaagggagaagcccagcaggagccagagctgtctgcacatggcagcaacatcagagctcagcctgggctgtggggtggggtgacattggcacagctcagccatgtgtctgcaacccagaccagccctggcctggggaagcttggggagggcctggcagaactcccttccaagggaggaggttgcacaggacaggatcccaagaggcctgagatggggatgaagctgggccagggtgaggccacttccccacagccctggaaatgggaggtcccgggctaccttgggaggatgaattagcccacatcctgctagcggttgagggggttacattattctaccttctaatctagaaacgtttatagaggttatttttttcttgcaggggtttcaagtactcatgagtttattttttcaactttttaactttgaaatgaatatagactcatttcaacttgcaataatagcacatggagtcccttgaaccctttgcctagctccctccaatgatgacatcttatcattgtaatacaatataaaaaccagaagactgacatctgtaaaacactgttagctaggttacactccttatttagttatcaaatgtgtgtgaagctttaaataaatggcttgcatttacaggacctcatcttagtgctgttccacctcccaggcccatgaagtaaggctgatgttagtttgattgggaggcagagcaagagacagagaggggtcaggagagaagaatggagacacaagcagcagtcttttctgaggtcgaaattatggccatgccatgtggctcagacacagtcagacttgacctgacccctctgtgaaccatcgcagcacaggacacaggccaggtggcactcttggcacatacctgggagcttccgtgcctactttccttgcttattctatgcagtgggttgaatggtgcccctcaaaagacatgtccatgtcctaacccctagaacctatgaatgtgaccttacttagaaaaggggtctttgtagacgtaattgagttaaggatcttgaaatgagaacatcgtggattatccacatgagccttaaatacattgataagtgtccttataggagacatccagaggagagacacagacagaagaaaaggccacgtgaagacagaggcagattggagtgctgcagccacaagtatgtggacaccaccagtagctggaagaagaaagcaggaatcctctcctagaacttccagggagagtagggccgagctcacaccacaatttcaggcttctttcctccagaactatcggagaataaaattctgctgttttaagccaagtttgtggtcatttgttatggcagccctaggaaaccaacatattctataatgcaaacggcccctctgcacagcccttgcctttcatagagcaggtagacagacattactggtttgtaaccactaacaaatggtcctcaggaatcaaggcagaacagttgatgccagttcaccaacaaggaaagctgggcacagagcactctgctgacctgcccaaggatgcaaagcttaggtggttgagcagtgactcaaacccatcttttgcttatgcccaagcctcattaagatccttgctaagatcatccagggccattctgagggacagttggttgcctgttgtagcatgtttttgttctagagttcaatctctttatttttaaaaattgccaactggcaaatgtcagcatctcaaagaagggcattgaccaggtacttggttatcttttcatgtgcccctgcctccatctgagacaaggggtaaagggaatcaccgagaaggtgggcagggccaccccccacacagcaagccctagggaaggaaggtggagtctggatccccacgaatgtccagtggaacatccactgccttctgctgcagctgtgggcagctgctgttccctggcaggccccaaaagggccccctgaaagccaagttctcagccaaccagtcccctctgtgcttctgaagactaacgcaggtcaagttatccccacagtcctaacctggtctgccagagcatcttccccctacacactttcccttggagtccagtactttatttttatttttatttttgaaaaggtattacatatacatgggaggaaaaaaaaatcaaaacatcatctccctcccactcagaacatgagttcctgaattctccttcccagaaataacaactattaccagttacttgggtttccttccaggcagaagcatgtagagctaaacatgtccttcttttatacaaatgagaggaccctgtgtgcatcattctgcgccttttcccatttgatatagcttgaagatttcccccaaacagtacacattcttgataacagcttccacagtattgccttgcataaataaactgaaatttctttcatctgccgcctgtaaagcaacacttagggtgtttctaatatgttctcaccataagcagtgctgtgatgcatagcttgtacactcatatttgtatttttagtagagacaggtatgtctctacttcacacatatgtaaaagtgtctccataagatcaattcctgaaagaaaatttgttgcctcaatggatacatgcattttaaaatttaatggaaactgtaaaattgccctccaaatggcttgtaggaatttatcgagccagccagcagtcagtatctgtttccttgcaattgtaccctaatgatgtgtgatcaaatcttttgtctttgcaaatcagctaagtagcaataaacatatgagtgctatgaaggatctggtgatgtgataggaatgtgtacatatgagtatgtatgtagaaatcattgagctgcacacttagaattagagtacctaaggaactttatgcatgctgtacctcaataaaaagaaaaatgaggccggatgcagtggctcacgcctgtaataccagcgtttgggaggccgaggtgggtggatcacctgaggtcaggagttcgagaccagcctggccaacatggtgaaaccctgtctctacaaaaaatgcaaaaattagctgggcctggtggcaggcacctttaatgccagctacttgggaggctgaggcagggagaatttcttgaacctgggaggcagaggttgcaatgagccacgattgcgccattgcactccagcctgggcaacagagcgagagactgttacaaaaaaaaaaaaagaaacaatatgaagaaaacaggatgctgagattcaagaataagagggtcccttccttacactgggcggtcttgaagtgcctcacttgcaaccttaggagcaatgagactcccacaaaggagtatctggaacccatgtgaaagaaggtttcagatacaaggaagagcactgacaatggacagggaaggaggcagacttgcttgaggaagtgaaaacagcaagctagggggactggtcccagatgaggctggaaaggttatcagagtccagatcaaacagagcctcttaggcaagaagttggggttattttctcatagaaatgggaaaccattgaaaggatttaagcacatgagtgacaggatccagccagttttgttgttttgttttttaatcacacagctgcctggagagtggattttaggagggaaagaatggaagagcagagacaaattagaagtctgctgtgtttttttaagctgagagatgatagtggcttggatcaggatgatgataaaaataggcagaggtggaaagattatgtatatatttaggaggaatgatctatgagacatctatcctgatcaagagacggtcagctttctggctgggcctagtgggtgggtcatggtgccattgtaccaaaagtgaagaaggcttaggtaggtttagattgaggtcatagggagaaaaatcaaaagtctggctttaatcatattaagttgtagaggtctaagaggcaagagacatcaaaatggaatcacccagaggagagtaattggtgggctgtgaaatgaaatgtctgtgtttacgtgcacttgcacagagacccaaactaccatcacccctgctttaggccgaaatttcacagaattgtgggcaatgtctgtctatagccatgagatcagaacaactctgtttcatggggatagtatttttctccacagtttgactctaggctcttcaagagcagagactgaatgttaaatctcctaaaccctcaggaccatagcatatgctccccaaacaggtaagtggctgagttgagggctcatcacagatttagctcatgggatctcaaatgaaagcagttacctgagctcagatcagtatccactaggagaagcatgggcctggccgttggcaagcggacagaagaaagcccaattccccaacccactggattcaaaagaccccacgggcattgcttccagcatccaaatgagcaaatccagaagtcattgttaatggtgctgggcctggtgccacctttgtcaaatggagactgcgaaaggttcaggaaatcccacagaacgcctaatccctcttttttgggggaaaaactgctactatcaacccatctgtcccatagcaaatgtgccatcaaaaaagccaataagactcccaaacttggcttattttatctgtccccaaaactagccattacctctgtcccacagtctccaagtttagtccttccaagctgtcctctgcagggccgctaacatgcaaatcttaacatcctgcctcccttcttaaaactccttgatggttcctgttgtctttaaggtagagcccaaaccagtcacacatatcttttacgatctggcctctaacaacttttccactcatacaccctgacttctagactaatacaccttctctctgttccccgagcatgctacaacctcatttctcaattctttgcttgaaagagctagttaatatttaaaagaaaataatatggggagatgctaagttcttggggaacacagattaaaatgggataatcttttccagttataaattggtaaaaattgttgaagatttaaaatactcagtggttagagagggggaagaagctgttttttttgttattttttatgttttcgagatggagtcttgctctgtcacccaggctggaatgcaatagtgtgatctcagctcactgcaatctccacctcccggattcaagtgattctcctgcctcagcttcctgagtagctgggattataggcacacaccaccaggcctggctaatttttgtattattagtagagacagggtttcaccacgttgatcaggctggtctcgaactcttgacctcgtgatccacccacctcaggcctcccaaaatgctgggattacaggcgtgagccaccaaatctggccaaagccgtttattaatctgttggtaaacacataagttatgtcacatttaaagtcctgcacacatttaaaaggcagatgtgctttcaccccagccaccaaacttccagaattcttgtccatcagactacttggacaaatatatacataaaacatgtttactccagccttatttgtcatagcaaaaataggagacaatttaaaggctccaaaaaacagagcagctaagtcacttatggcacatcctaagtggtgaattctaagaagttgttaaaaagaatgaggtgaagtcatatgaaatgatttggagggatgtgtatgttattttgttaaggctgaaaaaatagctgtaaaatcagattatatgatccagtttttggcaaaaaaaaaaaaaaaaaaaaaaaaaaaaaaacaagaaaagaatgaagagagaaatctagtatgcacatcatttctctcgtggcagttcccctgggcagtgggagtggggaatgatgagcaaataggaaagactttcatattttactttgtacattgctatataattaacatattttcttcacaaacatgcactccttttgaaattaaaagaagatatatataataaataataattaataaaaatttttaaagagccacaggacaatgagttagcaagggcaattgctgctgatagttgaagaagaatcaagcctcgaagaacatggaagaatgttccccaagatctgaaaggaggtggtttaggaggtagaagtaagaagagggaggccatttgcacatagaccccaaattcaaagcaggcttcagagcagacacttccagggccttatttgtgcaaagtggcagctgggagaccatgttataagaactgactgagatcagaaggtgaacagcatgtgagcccctgtgaggatcactcaggaccgctgatctcctaggaccagttgtctggccattgctgagagccatcagctctgtacctggcgccctgctggggccaacccttgtctctgttcacatgacctggtgggagcatccaccagaaacaaatgtaagacgaatatctcaagagagaaatgattctaaaggaagagaggctagagctagttcagacctcagctagtatgctgtctggacctcatatatcctttgtcctgccctcagttctcatgcctgagtcctgagccaagggggtgtgtgaagaattagaatgaatggggtgctggtcacattctttgtcttgatctgggtgctggtcgcataggtatattcagtttgagaaaattcaacaacagctgtacacgtaggatgtgtgcacatatgcatactatagtcaataaaaattattaataaaattaaatgtccctcaatctccactgtatcatttttcttaaaaagatatagcagataaggagggagggttctttggaccttaggagagcaaaatgagaggactcttttgtttacttgggcatctcaggggtcatagccttcctcccagcatgagtggagcccacagtgatggtggtgcccatgagctctattgtaaacacctagacagggttacggatgtagccatagctagagatacagatttatgcacctgggaattttactcatatgtttgatgttaacagaaaaattcctgaaaggacgcaaactaaactaaggacagtggttacctgggtgagtcattcctactttttttttttttttttgagacagagtcttgctctgtcacccaggctggagtgcaatggtgcaatctcagctcactgcaacctccgcctcccaggttcatgccattctccttcctcagcctccggagtagctgggattataggcgcctgccaccatgccctgctaatttttgtatttttagtaaagacagggtttcaccatgttggtcaggctggtcttgaactcttgacctcaagcaatccaccctcctcagcctcccaaggtgttgggattacaggcgtgagccaccacgcccggcctcgttcttactttttgtatcatttatttcttcattatttgattattcctacaaaaaatgtatttttaattacaacttattaaggtcttttctcctcttgcttgttgacaaaactttagacatccttgaaggtgcaatcttttccccatgacactttctctgacttctttgtacaggttttctcaaagttttgtcctcccaccctgactacttgtcctagaatcacctggggagatagttgaatttgtagatttatgaccctcttcccagactggctgaagtataatatctggagctcatgaatctacattttaaggcaattttgttgctcattgtagttgatcatctttgggttagatgacgaattcctttcttttctaggcattcagacctccttaacatctgcattctgtggcccagggtttattgatcccaggactgtcttctccatgagactgcagcccctcaagggcagtgactatatccaattcaactaactttcctcagggtttgacataggacccatgacaagagatgttcaataaatatgtgctgaatgaatgaatgaatgaatgaatcttcatcatcacacaatcactggggtcccaaggatgagacttgcatggtgggccagtgcagatacagagctgggcttggttcaggtacatttttgccactctgaggaactccagcttgtgatcccaggctatccttagtagagaggagccaggattggtgagataatagggaaacttcaaaagccagtgaaaccagccagaggagccacccagtaacccagattatgggattcagtttctatacattaggctatctcaccattaacattaaaagagctgtggcataaatcacaagcagcatggttccaaagattaaggacccctcttaccagcaaattcaaggtcccttaagagtatagaacagtaatctcaagctcgcactgcaaagccagtgacctgggttcaattccttattcaacttgttaactatgttttgggcttgtttcccctatgattctcagttgtcccatctataagctgagaaaaatactattgcttaactccaagagttgttgcatcaggttagatcatccatgcaacaaatattccttacactcctactgtgtacccatgcccggtactgttccaagtgccagggagttaacagtaaagaaagcaagcacaaaaccctgtcttgagggttaattcatgtaaagcagagtccgtagcacagagtcattgcttcaggtggtcaaaggagactctttatatccagacctgatggaccttaaagagcaatctctaagctggctgtcagttcctgcatctagaaattaagacacgcaaggaaggtagcaaaagtcatccccagatcctgtgcaatggtcaaagaggtatagtaaatggctaataaatagaagctgtgaaaattgcaactgtaatacccaacttgccctgggggagcacagaggcagaggcagtgcctcttagggccctgaagcccagacaggagctgtgtaaacaaagcgcttcaggaggaaaggatgccaaaatgtgtccccagccacagagtggctcagcagactcccccggctccaattcttggaaataagtagctccttttttccagaagaaaataaacttaaacaggaaagtgcttcatgattcagtgggttactcggggccctggaagtgtgagtgtgcctgaagacgtcggcagtggtttacggagcaccccagcattggggaagaagcccagtttcctgaaagtgagcatggcctgagtctgtgtctgtttatgcccatgtccctggtacagtgcatgctaacacgtgcctctgtacatttgtatagtgggtgcacatgtgtccaggtgtgtgtgtgagtgtgtgtgctcccatgcaggttggtgggaatatgtgcctgtatgtggctttgcctctgctcctgaggacctgggtttataatttccacacacatttctctgtgtgtgtgtgtgtgtgtgtgtgctgtatgcacctgtatttgcttgtgtctatgtctgtgtgcttggataactgcaggcatgcttttgtgatgagcagaagaggagagagaaagcaaagacagtgaggaaaagacctgagccaggagaggatggggttcaaagcctgcggagaagtgtggagtaggtgctgagtcctcttgagagatttctgtcagggatgtggtgaggaaacagacccagagtgccccaccacagcctccaggaatgggttctgggttctctctgatctggtggctgctctgatgtcagggtataaggtggctctgtgggcatacaacagcccagcaagatctccaaggggctcctccacagccccacccaggggatctggcccatcaagtggcacacattaagacttttagtaaaggggaatcatgagcccccactgtcagccccggactgtgggaattatgactttccaacaggaggggaatgaaggctgctcccagcttctgggcactgctaggagatcctgggaaagaataacctgtgagtccagcccacaccctgggccttcactgtccctcaccagccggagaagctccgtggctgacacggcggatcgctaatatcccctactcaccccaggagagctgggcccaggcttcacagaagagaatgagttattcacatagggaaatgacaccaccagaggtgctgccatcagtggggtgcctcttgggaacttaggcattaagctaaagacagtgacagggtcagcgctagtggggcaaggaccagtgaggtgaaaaagaacagtttcctaaagaatgtgcagacatttcaggactctcgcctctaggaaaacagagagcttccacgttttgggaaattttcatcaaagaatattttctttctatctggtagtgcaattaccccgggcttgtcccccaagctgagagggcctggcctcgcagtttacaaagacaatcgccctggacaccagattccgcagtcctgggggctataagtagcttgtgcagtggcctccacttcctcatgtcagttttctctgagattttcctgatcctctagctgaccacacccactccaaccaagcacacagagcttccagagaagtctgccctgtcttcagttcccaagctcaggcatgtgcaaatgaggcccactcctaagcaaatggctgtcccaccccattctgggtctttcttatgggattcaccctcagtgtctagtcttagtggtaaaggatagagtagaggctcaaatttctagctgggattgtaaaaaactgcctacctgcctatccacaaaaagacacattcaacatgtaagaggtgaggaccaagactctgtcttctccagaaacactctcagacctgctagtgagaagccagctgggacaggctgcactgatccctctccctgacacctcagtcctatcagcaatcctccgtcccatcctcaaccaaggtaccacttttttcctgaatggcaaattccattttagaaccctgggaagtcctacatgtgtctgcctaggactcaaagctcaaatagaattggaactcaagaccggctataaatggtccagggtttccattccctctgcatttgaacccttctagagaacacctttagagagagctgaagctagggacatagtcattatactctcactgaataccaattgccgtcatcaggaaaagagacagagagaccgctgtgccctggcactgagaccagagaagggtagtgagcatgaattatgtattacacaagcaatagagataagagtggaatggggggaaatcataaccctattaataatggaagtgcagtttgtaaactctccaccaggaataatttgcattgcaatataaacagggagtagaacacagagcagctggcaatggcgtttcagtaaaatgtaaaagccaccatttcgaacattaaaagtcatgattaaattataagaatttgttcagcagcgtgtacaaggagagggcacgcgctccgactccatctgagcacagggtcagcccttcctccacatgtcttctaggagcatgaaccaaggacttgcttgggtccttgagaccttgccaattcctatattattattactagtatttgttgttgttgagtgcctgctatgtgcaccactgtaagcgtgttgtgtgcaataacagttaatttttgaagcaacactatgagggaggtcctataacatctccattttataaatgaaaaaaacagaggctaaatggtttgccttaggctgcaaaattgctaagctggaggtgttgcggtgcaaacccggacagtctgagctcccagcccaccctcctcaacactatgccctggtatctcttcgggagctgctcaggtgtccctttaggcacctctgaaacggtgctggtgggatggaaaattggaaccaaccttttaaaaaatgacttggtagtatattaggaacttgatcaacctgtgaccaagttgttcttcatttctaggagtctcctgaaaagaacttaaaagcattatgatctctgatagctactgaggtataataattattagatattgatgtataaaagctctgggtacaaacatgggttttattaccacattatcatgtgaaaaaattagaaataaccaaaatgtctgatattcattgaattgttaaacaataataggctgggcgcgatggctcacgcctgtaatcccagcactttgggaggtcgaggcgggcagatcacgaggtcaggagattgagaccatcttggctaacatggtgaaaccccatctctactaaaaaataccaaaaattagctgggtgcggtggcgggcgcctgtagtcccagctactcgggaggcggaggcaggagaatggcgtgaacccgggaggcggagcttgcagtgagccgagatggcgccactgcactccagcctgggcaacagagcgagattccatctcaaaaaaaaaaacaaaacaaaaaaacccaataataatgcataaatattatgcatccaaaaggggaattgttgataaagaacttacaataacaagaaatgtgcttgttaagttaaacaagtacgatataaaaggatagactctctatgagctccactgagtaaaacaatatatagagaactgtgggcatgtagctacaaggttactaatgttcctctgtgtgtcaaaaagtatacatgtttccttttctattttctgcattttccaagcatatattaattacttttacaatcttaaaaattatatagatagatatagatatgttgatacagacatattgattgattcattctgttacttagtatatgtaaatttgaaggtgccctcaccatctcaattgtaaacaattatagacaccaaacagaatgagaacagccctctttgtccccagcttgtcatccctgtcctcaaagtcctgtaggtcccactatccaaggagttcccctcactctctattgagtgcctccctcactaagccatcggctcagaactgcctggagcagaagactgggactggaacactgtcctccacacaacataaagagtgccccatgtgtcacgcacttttctctatggtttctataagcatcagacataggggaaagcacctccatctatgtctgtggatctagaacccgacaaccccatgcttgctcccaggaaaatcaggcgaagctgggagtgcctgccctcatggtgaattcgataaggcactggtctatgagacactcctggctctatactgaccacctggctgtgtgatctcaggtaagtcacctgagctgcagctgacccttccataaaatgggaatgtttgacttgagcatgcgaaggctcttttcctgccatgagagtgtacacacataaggtcacatgagtttgagacaaatctaaatgggaactatttcaaggctgttgtcgagcattccagtgcatggtaacataaaggcccagctgccttgccagttcagaggctggcagcagagaaagtgagggcagtggagttagaacaaggcggcatgaacatgtggctggagtgagctttgggcagggtggccgggctcctggcctcccttattggccagagtgttgtcatctggaatacaggcagatggactttgtcacaaacagatgatatcccatccaatgacctgtaagagtcttaatgctgaacaccctggcaatgggcagaccatggctcctcctggaggatgatggaagcagggaagataactggattctccaagatgggagtagcattcaagaagtgggatgtcacaagactggggacctagaagccccaaaactgccaggaggctgagaggctctgagcccaggttgggaagggagcagacagcaaactatactccccagtgttctcagcacattattgacattccagagaggagaggcagagaattaatttcatgatgacttcctcccccaatacccatccctctcccctgcccacacaatccccagctaagtccaaatgagggcctgagacttgcaggaagacaaatgatcccaatttaaaaaatgctccagaggcctccatattccattccttcatttgttcctccccagtgtcccacaagaggctgcagatcctaatcctgggcacagtggcagtggcatgcagttggtgctcagtaaatgcctgttggctctgaaccaaatatcttcaaactgccctgtgagacatcactttcccagaggggaggacgagcatttagcattaacttggttcttattctgcaaagcgatcccagtttccactgcctctgcctgtgaaagtctccctactgccagtgtcccaggggctcacagtggcaggaggcctgggggctttctcacagctgcctttaacatttccttctggttatgccccgctgctctggtgactgatgctatttgtcagtcaccacccaggggagtcatggagaaagattgcccaggtgcctgtcacaatccagatacagccataggtgctgacaccttgtcactgtgtcaccccgacctggtcttattggcctttacatgttgcttcccaaagagacatcaggagatgtcagaggctaagtgggggcggggtggtccctggatcccagactcacctccctatatctgcagcagaaaggtagtcacagaaatgcaggaaggaaagaacacagcctttgtggagcctggaaaattctgggctcttggggcaatgagggaaactgaggaaggagaaaatgtcaggaagcagggtctgcccaagatggggcacagaatcacacagaattcgcctttcaagatctgattataagaaaataatcaagcacagggactacgacttatgtccaaagatgggcattttactgccatgcctaagagtaggaaaattagaaatgcctctgcttggccgggcgcagtggctcacgcctgtaatcccagcactttgggaggccgaggcgggcggatcacaaggtcaggagatcgagatcatcctggctaacatggtgaaaccccgtatctactaaaaaacagaaaaaaattagccaggcgtggtggcgggcgcctgtagtcccagctactcgggaggctgaggcaggagaatggcgtgaaccctggaggcggagcttgcagtgagccgagatcgcgccactgcactccagcctgggcgacagagtgagactccgtctcaaaaaaaaaaaaaaaatagaaagaaatgcctctgtttactgtgctaccctgggcaagacacttcactatctaagcctcagttgcatcagctgcgaaatgggaaaaacagtaatactttatgaatttgctgcaaagattaaatgagataatgcacagaaagtgctttgcatagtacttgccatagagtaaattttcaattttagtaaatagcatttagtaaatagccagtagcaagtagccgttactaaaattgcatccaaaaataatttatcagttacacaaatggtgacatgccaaaaaatagtgtgaaatactaagcaattgaaagcaggtttccttccaaagagatttacagtgaaggggaccaagcttatggtataatttataataatatgtatctatgtttttcctataaaatgtgcatatttatagtgaggagtgaacttaattttttattggaactttattggaacttttttttaatctatgtccaaatttcactagtggggacaggaaattcttggctgaatataggaggggtccaggaagccagatggaattaaggaggctgtttcccctaagcagatgaaatcctgctctgaaaaatatttcctggttatcccacactgatttagtctgttcatgtgcatgtgtatgtaggtggttgtgattgtgtgtttgtgtgtatgttgtgtggatgtgtgcatttgtgagtttctgtgtggttgggtatatatgcatgtgtgtttgtatgtgtgtctgtttgtgtacgtgtgtgtgtctgtgttcatgtgtgtgtttgcgtatgtgtcccttgctgcatatgcattccctagagcagtgtttccagattgttcaaaatgcagattctaaacatagacacctgaccagagcagggagtatcctgaactctgaatatgtgtcagttttttagggattcatatgcacagcatatgaagagtttggtaactctaaagacaggtatcttaccctgttcacttcaaatcaccagtgcctggcataggacctagtatataagaggtccaacaaatggttattgaatgaatgaatcagtcaaccaatcaatcagttaaccaattcatatcttcccaactttgaggaaaatacacatatcctgaactgtactagaatgtgagttccctaaggatgggaaccatgaacatagattttcaataaacttggtgaattaattagttttccctaatatcgatgtaaaggaaggctcttcttttcctagaaagactgtctttcttaacagagctcatggtcacaggggaaacacagaggagcagaaaagactcttaacagtgtccactcatgccagcacatggtctgtctgtaggagtatgggtacaaatgaaaagtggtgacaaatattactcttacagcaaaagactgaataagaacaaaactagaaattgtagctgcagccacctctcaaatctatatgatttttcagagctatcaagtttctttatcccatttgatccaagacaatggagtgagtcccactttgacagataaaaagataaagtgactcaaccaagtttcttcagctcctcaggggtatcaccaggccaagaatcctggttgtcaagtcgagcttcattttcaggattctttgttagtataatgatgaagactgtaattttcctttgtttcgcctcctcagctcaactataagcagatcccgacttcaggaagcatccagctaaatgagttggatgtgtccctccaaaggtttaagcaatgaattattatttcacaggtgcctctgattcaccagctctgaatagctggactggtttggcttgtttacacgcaaatgcaaaagccattagggagccccagttccaacactgcagattttgttctaagtaccaacatcccaaaatgctctccattacttatctggaatttcaaaatcatgcaacaaatgtaagttacagacaagattttttaaaaaataataacagcaatgccagagaggaaaacagaaaaaaagaaagacaatatttttcaaatattttcccaactgtcattttaataatggcctatcaacaaagtatgctaatttccctccacagatacctgcgaatgcaaatgcaaaacaaataataattaatgtctctgtgtgaaaatcaagcaatttctattaattctgcatcagacatgagattatgcacattcaaaatcatgatctgttttcaacagcaacagtgacaattgtaaagaagaaatggtgaggggaggctctggagttaacagaatccacatagccatccttgatatgacctctcccagcttcccaacaaaatacagtcagctcttcatatccacagatgcaaccaaccacagacgaaaaatattcaaaaggaaaaaataaaaacaacaataaaaaataaaacacatttaaaagtacagtataacaactattatatttacataataccttacattaggtattataagtaatctacagatgatttaaagtatattaggggatgggcttatgttatatgcaaatactaatatgccattttatgtaagggacttcaatatccacagattttggtatctgtggggttcctgaaaccaattccccacagataccaagggacaactatatatacgaacactcttggaactaagaagagtaatcaaccaagtgtcaaattataagcaaaagttttactagctatagcataaaaggaaactgataaaaaataatattcttgatggtgagtactgacatctgaaccagagtatcaaggctggaaggcactgttgagccctagctcacaagcagagactccagatctttgctgattaaaaaagcagacaccctcctctctggtatgctccaagagcttcctaaacccatcctccctgaaactaccaagaatggtcttctttttttttttctttatttcaaaaaaaaaaaaaaaattggatacctattgacccgtcctctaagttccctcccctcacccctcaccctccatgccccaacaggccctggtgtgtgttgtttccttctgtgtccatggaaaaccaaacactgcatgttctcactcataagtgggagatgaacaggaatggttttctacttcagtttatagactatcatctgactgcaatgtcacatggagggaagtggaagagatccaagatgggatatgatgctggcattaggcaaagtcataaaaggaggcctggaagctatgcttcttagaggttgtgaggtttcagatattatttctaccaaagggtagagagaagactatctcagaatgtccagaaataaatgatctgtttcacactcaaagaatcagggaacaaaagatctcacaacagtccagcaaagtacattgtagtcaatgcatgaaggaaaatagaaacccatccacagctatgctgtccaacataacaggcactacttatatgtggctatttaaatttaaattaattaaaattaaatacaattaaagattcaattcctaagttcataatcacatttccaggactcagtagccacatgtagctagtggctagcatattggacaacatagatagggaatgtttccattgtcatagaaacttctattggatagctctgatctagagcctgaaaagcctgaaaacataaactccaagtgacagatatctttcacttattcatcctcccctactctatcccatgctcccagaaggcagacctctatggcatatggtaaaggacttcttgttctttttttttttccaactaacttttattttaagttcagggggtacatgtgcgggtttgttacatgagtaaattgcatgttgtgggggtttggcatacagataattttgtcatctaggtaatgagcatgatactcaataggtagtttttcagtcctctcccctctcaccctccaccttcaagtaggccccagggtctactgttcccttctttgtgtccatgtgtactcaatgtttagctcccacttataagtgagaacatgcagccaatactgtatatttggtattctgttcctgcattaatttgcctaggataacggcctctagctgcatccatgttgctgcaaaaggcatgattttgttcctttttatggcagtatagtattccatggtgtatgtgtaccacattttctttatccaaaacaccactgaagcacacctaggctgaaggaattcttgttctttggtctctggttgacttcagcgataggagggcactagaatgacactataggaccagagagtgaagtgaggcctttgttgctttggtttctgacttcctccctactggtcattgtgatttagatgtccctctgttaaaagctgtcactcttggcaggcagctttccatataactattctctgggctctggtaacatttccctcctcctcttgatccttcaggctgagggtaggtaaaaatgcctcacaagcgactcgacttggggcactgcatcatcccttttttgttttttgtttttttgtttttttgagacaagaagtttcatttttgttacccaagctagagtgcaatggcatgatctccgctcgctgcaacctccgcctcccgggttcgagcaattctcctgcctcagtatcccaagtagctgagattgcaggtgcccaccaccatgccagactaattttttgtatttttagtggaaatggggtttcaccatgttggtcagactggtctcaaactcctgacctcaggagatccacccaccttggcctcccaaagtgctgggaatacaggcatgagacactgcgcccggcctgtgttatccctttttagagctcctaaactcctcccacaccctgggaaatgatcccttaataaatcttttgtcaactacctactatgaggatgttatgtttcccctgagtgagtaccctgatgggtcagattctgctctaacttaagtctgaggaaatgactttatcaaaatctacagagaccgcagaatctatagtcccctggggcagaccatggatttagaaatatgtctttccatttaacaatgattaaacaaaggaaaatagcacaggagttagcaaatgtttttcacgaaagcccagagagtaatattttgggttttggaagctatacagtctctgttgtaattacactgcagtgtaaaagcatgtagccatagacaatatataaatgaatgagtgggtctgtgttctaataatttcatttacaaagacaaggaataggttggatttggtccatggactgtactttgcctaaagatgccaaaaaatgcatgcctctgaatttatttactataaaaagaagaaaatatatatatatatatatgtacgtgagtgtgtgagtatgtgtgtgtgtgtgcacgtgtgtgtgtagttctctataaactgcaagaatgtatggcttctaggaagagaaggagataaaaaatgaaacaaaatgcaaaagcaaaatgcaggctaaggtgaagaaaagtcttgctgagatatcaaagaaggcagagaaacaattaatacactcttagaattatagtttacattagaagcaataaagagcagaacttatactgcagaaaactaagtttcagagaaataataaatttgaaacatatcttttagaatctggagttgaaaataatgagcaaacagatggcatatatgaagaatagagaaaagtgatccaatttacaaaaagaaaatagtgttcctttaaaaagtctctaaaaaagtaatgacactgaaacaccaatcaaatctatattagaacattcttgaactgaaaataaaagatctaaaattgcaaaacaaaatggtatactctgcacaaatcataattgatttaaaaaaaaaaagaaacccacagcttgatagcaaggaaaaaataacttataagtatcccaggcagaaaacaaagcaaagcaaaaataataaaaaccacattgtttgcaaaagattaaaaagaaaaaaaatcagattgggttgacctcagaactctccttgatgaaaaattaaaaataaacataatggctcacaatgtggaaatggttaggtgtacttacagtacaaccagatgttagaatattatgcaactatcaaaaacaatatagtattaagacaaatataataacaaatatagtattaaaagaaaaacaatataagtatcttccaatctcattaaaagattggaaaatacttaggataaaatatttagaaagaaagttagacacaagaacatatataatatgcatgtatgtgtactaacacatctactgtatttctttctagccttttgtctacctgtatatgcaagtagaaaaatactgagtattatttgcacatcctgcaccactcaatagtttaattctcccaatatatctatgaaatagtaacaatatatcccacagcacacttaagaacactgagggttggagaggtcacgaacttgtccagatcatccatagttggtggcataaccaagattccaatcaaaatctaaaatgaatatgtttcccttatgctagcttaatgagggtggtggctgcgctctgtgggaggggaggagataggaaggatgaatctgggtcctgagagaggataaggccctgggtcttggtgctatcagcagtagttaggctggacagatgggaccagttttcctttacccagcatagctctgagatgtcccttcagaatgtcagcagtgacccatctccctctggccatgatctcacctctggggagcctggaagaaccaacagaattcaacagaaaccccagggctggctaacttgaaggatgactgatgttttaccaatttatcaaaatatgaatttaatgttgtaatctccttacatcactatgataattctctgtttatagttagaaaaaccttaggaggaatactactatctcctcttccagaagaacagatcaggagcaaagctacaaagattgtacacagttctgaaatatttacttcttctgaaggaacattttataaagtcaaatttctgtgctgggcttgctgatggacttaagtctttgggcagttttacagacaaagcagccaaaacgaaaaaagaaaaaaaagtaaaagaaaagataaaaagaggatacctttctccaaaaggtggtcagtagagaagggtgtatttgttcaggactttcaagttctttatgaagtgagagactttgctcatttgttaattgatgcattcattcacccgaaacatctttatgaagcatgagccgcagagttggactcacagaataagaagaagtatcaaaacattgctcctgtttccaggaacccacagtctggaaaggcatgggtgggggtgtttaaaaaggaaagagagtcacataacccattgtgtggtttagaaagcccattctgtgaaataagcaagtggtagaaccaacatatattgcaaaaccatttatttgaatacaaacaaaacacatccaaagtaatgctatataaatatgtaaacatataaagacatcaactaaatatgttatcacatttatgattctggttgcctttggggaaggaaaaagaattagaagaattagaatgcaggtgacttcccgtttatctttaaaaatgtctttcttaaaaagaaggttcaaaataaacacaacacaaaaaaaacacacattgtatgactgtatttttgtaaagttcacaaataggcaaactaatctatgctattggactcaggatagtggttacctgtgatcaggtagggtgggggaataacaagaaatgggcaaaaggagaggcgggtaatgttccttttctttttgtggtacagttatatgactgttcactttgtgaacattcaacagatgtacattaagatatatgtacttttccatatgggtgttatttcaataaagatagattagatagatagatagatagatagacgatagatgatagatagatagatagatagatagatagatagatagatgatagatagataatagaaagaatagaggaaaagcatctgttgatttggagtagcaaatatatggatattagctataatatctctgcacttttctatatttttaaatgttttttcctaattatgtaaataataaaaacatagaaaagacaactctagctgccctatagagaagttagagagtggagtaggcagaccagctaggaagttattgcaggagctcaagttagaaaagatgggactggagggccaggtacggtggctcacacctgtaatcccagcactttgggaggccaaggtgggcagatcacgaggtcaggagatcgagaccatcctggctaatacggtgaaaccccatctctactaaaaatacaaaaattagctggctgtggtggcgggcgcctgtaatcccaactactcaggaggctgagggaggaggatcgcttgaacccaggaggcggaggttgcaagtgagccgagattgcgccattgcactccagcctggcaacagagcaagactccatctcaaaaaaaaaaaaagcaggggagaagataatggtgaatttacaaggtctggtgaccatgggttatcccttcggttgctctgtggactttgagcaatccatctgtgtgattaaccccacacaccaaggtctcagtcacccttgaacatgggaagaacccctcatcatctgcagggtgagatgtgttttgccctgaaatccccttccccagtgcctccccttagcctgccctcctctgatcctgaacccccagccaaggactcccccagagccctttaattggcttaaacactagacaggagattccctggcaggggtaatccatgattgaactagggataatcagcatgattcatttgtctgattaaaagctctcactccccattatcacctacctgagaggaagccacacagggctctgacagcaggtaggcaaaggctcagggcctgacactgtggcggggtggggaggggggcagagtagaaagtgattgaatgacacagggcacaaagctcacagcagcacttgtccaaaaggaactatagaaacaaaggaatgggaaggccggtactcacaacatggaaaatatccacctggtggggctctgtgggaccatgcacatcccgcagaaatgcctgtgatttggggacgtttttcctttgatcctcatagataaagggtttctgcttccccgcctcagaaaggagcagtttgtgtctgagcacttgctattcctctcttcattccctcactccttccattctgtgagaggagaaatgattggtctgactggtgagtgaaaagagttttccattcactgcaccatatttgccagggcagagttgccattctgaatcatgaggtttcctctcaatctctctgtcctctattcttttggacattgctattctcagagggagcccactttttggcatcctctatgtggtcaggtcatgagggcagctacctgccttttgcagaccaaaagggcctgtgttctctttgcttcactttcttcgcatgcaacaggttgaagaaactcagccatcctagtactagaggcctggggagagaaaaagcaaacccccttttgccgaatgttccctgtaatagattgtattattgttcctattctttatgtcttcctgtacctttatcttctgcctgtgcctttggcatactccccaccaaaggaggggtatatttacctgcaggtcagttgacatagtctgggctttaatccatgctacaggttgggtccacctctgcctcacacatctctccgtctccacagatcagtgggccagttccatgcaggctcttcccatggaaatggtaggagagcagaagcttatgagtggagacatgagtttgttcataggatttgctttggccaaagtaatgtgggtagaagtaactatgtgaactgtgtgctggattcaagcctgggtattagaagacatcacatgtctccactcacaagcttctgctctgcttctgccatttccatgggaagagcccgcataaactggcccactgatctgtggagaaggagagatgtgtgaggcagaattggacccaacctgtagcatggattcaagtccagcctatgtcaactgacctgcaggtagataagtgagaataaacgctgcttcaggacactgggttttggtgtgattccttgtgcagcattattgtaacaagagctagctgatacaccccatcatccctggttctccaggtcagtaaagaaaactatcactctaggttataatgctaatattttgcccagtttggctgaatgctttgggtttttactttatcgatcaagccgatggagaaaagtttcaataagtgggaggagtagagcacaaagtctagggtaatcatatgtcccaatgggcctggatggccctaatttatacctgttatgccaatataattaataatagcacccttctgtccaaaagtacatcctggtttggatgattaaattatatcaccctagccaagcccaacaagatccagcctaaaccatgtcttccttacactaacaatgggcacccctttgtggtcagtagataccccagaattttttaaaaagccatgtcctggaaggcaggaggcctggacagcaattctcatggcagcaggtgaggtaaaaataatacttttcctaaatgcagtctatctgcacaagattttataaaagtgctatggggtattttctgagaaataaactccttaatatgacttcatggtaagagttctatttcctttattctcaggagtcctagggaagaaaaatatgccccctggcagtgttccataaaactaatgatgtgggggaatacgtgaataattgcctgaatcgccgggttacatatctgttaggaaatctcttggcaatataaagaaggggctcaggacagttaaattgaagtcaagtgaaataaactcctgctgcatcagctcgatgatcttgtgggtcaagggagctgtggcagccctctctgcactttgggaatgttgggcctccaagttttctgggttcagagcaacagggacataggatgaggagtagaaggaaggaataaacaggcatggaccagacattgcagggatgcaaagggaagttctggagccaagtcttcaaagctacagatcaaaaactcgggcaaggagcagtggctcatgcctgtaatctcagcgctttggaaggccaaggtagatggatcacttgaggccaggagttcaagaccaacctggccaacatggtgaaacctcatctctctgaaattcaaaaattagctgggtgtggtggtgggtgcctgtaatcctagctacttgggaggctgaggcatgaaaatcctttgaacccaggaggcagaggttgcaatgagccaagatcatgccactgcactccagcctgggtgacagagcaagactgtcaaaaaaaaagggagggagagagatagggagggaagaaggaaggaaggaaggaaggaaggaaggaaggaaggaaggaaggaaggaaggaaggaaggaaggaaggaaggaagaaaggatgaaggaaggaaggaaggagagaaggaaggaaggaaggaaggaaggaaggaaggaaggaaggaaggaaggaaggaaggaaggaaggaaggaaagattactggtgagtggtcagatagatggatggatgaatgaatgaattctaagtgtggggttattccttgtgcaatattgatattgtacttcataatattatacttccaaaattattagagtaaaaggaaatgattcaaaaagcaaggaaaggttcagtgtgctgaaaaatacagtaagcccaattcctttctcacccaccccactctcagccacggaaagaggactgatactacagcatcagagaccatccaagacaatacagttgtccctcagtatcctcaggggattggttccagaacaccctgtggaaaccaaaatctgcagatgctcaagtctctaatataaaatggtatagtatttgcatagaacctatgcacatcttcccatatactttaaatcctctctagattacttatacctaatacaaggtaaatgctatctaaatagttgttatactgtattgtttggagaataataagaaggaaaaatgtctacacatgtttagtacagatgcaaccatccttttttaaatttgttttcaatatttttgatccacagttggttgaatccacagatgtgaaacttatggatatagagagttttatgttttttgagagagagatggggtctcactatcaaaagcctggggttgcccaggctgctcttgaactgctgggctcaagcaattcttccacctcgcaatcccaaagtgctggaattacagacgtgtgccactgcacctggtccaactgtgttttaaattattcttccagggtaatatagaaatttggataaaattcttgaatttgaacaaagtagacaccagtttgcacaatgcaggacatcaatccatccatgccctttgtctccagatatctggtgtggatgtgcattcatgtcaacacaactttttaaattgcattttttcctccttctcactcatgtgtcttcagagtaaactgaagaattatttcagtggagccataaacctctcggtctcccaagacatacatatggactccatgtcaattttctctcccacactgcacctgaactatttcaaactatcttcccagttgaccaaaccagaaacctcagagtcgcccactactctgacctctctctaacccccaacccgttagtctttctctcataaatctctctggttcttccagcccacagcctgtccactctcatccaggtctccaccacatctcccctgggttgtaggagaagctcttagctgcctcttggcctgggctctctcctttaaatccatcctatacctagaaaccagagggatttttccaaaacagaaatttgacctccctggtcccctggcaacccatcaatggcttcatgctgtctttaaattaaatctgaaccccatgtgaggctctgcacaattcggcctctgcttgttcttccagcctcatctcaccactccctgcttctcacccgaggcctagcagcagcctccatttctctggctccttgttttctgtcactttcaatcattagacctcctcttctagttcctggaactcaattgctcactccatctcaatcctttttttacctaagcacgattctttcactccacaggttttgctgaagtatcctaccatattctgcaagagagtatctcaacatcctcctagcttaacacttaacaacatagtattatgttagcttgatcaactcactctcctccccttgtctgaaagatcaaaaaaggcagccccaggccaatcgtgtttgtgttcctagcacctaggccaattcctgacttaaagtaggtattagaaaaaactttttgaatgccagacaaatccatgaactgaggacaactctttgtttattcaacatatattaatggagggcctgatatgtgtcaggtatagttctcagcgtgtgggatacatcagtaaaaaacataaaatgcctaccctggtggtgcttacttttcagatggagggagacatttatttacatatttaacaaatatttatccggcagagaatcattgcacacacaaaaaagatggggtggcctggccagacatgtacatgacagatcagttctaaaatattttccttgtttttagtttctacttcaatgaaaaatttgtcgtcatcttagtgttaccgtcctggaaattctcaatgtcctctttgcctgctcaatgtttctctgtaacagtgttcatcatctaatataaagagcaacacaaacacatagtttgtgctcaatcaaagcttgtggaatacagaaacaaacaagaaactccaagagctcattcagtaaacttacaaacaagtaagaagatgagcttatgatcagcctgctcaaagcaaaagaaaagggaaggaaacaatttttctaagagcccttcagaaaagggagaaaagctttgcaaaactcagagaacccaggagcagtaactgatctttatgatccagtacagaagcctgagtaaccgcaggctgtctcaggttttaatacaaggttatttacatagttacctaattattatgtctcaatagagggaaggaaaaaaagcaagtgtttttctactccctatttgccttaaagatctaagggtaataaattgttagttttattcttaattggtacatgcttcttccaatttcttttctttaaaaaaatcaatacgtggtttgcgagacctttaatggagagtaaagaactgtgactagacttcttccttattattgagataatctgtcagcatttatcttttaaaggggcctcaggtaaggcagacatgattaagtttttgcagtagtaaatgctgggccatttctagagttaaaatgatatgaaaaatataactgcatcaggctatgcctgataaaagacagtgtctcttttgcaaaaatgtgggctgtgggtctggtctgctgaggcagggctcccaacatcttggaaatgttgtgcccaaccactgcccactgccctggccgagctcctgcccccactgagcttcgggaagtgactgcggctgttcccagcgagcctgaccagaggcagaggccactggtaaccttaaccccacgtgggcaggccctcgtcagagcctctccccaaccctaaaattaaccagtaagtttttggaaggggaggtggacagagaagtgcagggccctgtttgctctttggagcccaaaggaaacaggagcctgggagctgacaccctgggcctgaaaaattgtaattgttagacaagcccaggcatgtgaacaagagcttccctaccccaatctgcaaggcagacaccctgagagtgttagagttggtatgggcagggtccttcacactctgaagtatgtggttacccagcaggctggtgggcagagcatggaaaagtccgaatcaaccataatcaagtaaatggctaaggccgagttcaggtaaggccctgcctacaaatccaactcacattacctgtgcacctcattgtgcctgtgccagacaatgtgcctcaatttaacctttgcaaaacttgtctgatatggacatttgtattctcgtttgatagataagggagtaagggctcagagaatttaattaaccttcccaaggccacacagctaaatggcaggactaagattcactatcagtctgttgtacttctcaagttatctttgctctaccaaacatcccaagcaaagaagttaacatgatgtaatggtgaagagcatgggctctatagccatagcgcctaggtttgaatcctggctctgctacttactagctatgtggctttaggcaagttacttaacttttctgtgccacagttttctcatctggaaaacagggacaacagttgtatatttatcatcgtgtgattaggagaatgtaaatatgtgaatatttgtcaagtacttagaagagtccctggcgtataatgaatacatatacatgtttcatgtgtgctaaataaataaaagaaagggatcttttcattctcaccacacaagagttcattttccagtctctggactcagaagaaggtgttttgcagtttcctaacatcatggagtccgaaaagtgcttttgctacaagggtctcactttactgtcacaacagctgtctaaagaagaaaggaagattagacccatgtaacagaagaatacactgagacttgacaacatgaggacctttataaggtcatttagcaggtaaataaagagcaagaaagatccaactcgacctttctgaccctgaatccgtgctatgcccacactctaaataaaagcatgaacttgtgagtttgtggatgaaagcttggcattgcgtccaaaatgaggccatgggacagactgctgctgccatttaaccccaggtcctgagaaattcctcaacccttcccatgagtcagggactcctggattcagtgctgctgtggactgcccattatgcctctcccctgtactcaggagatggaagactctctagagttgaccactgtgaaccaaagacaatagagtgttctctttttgcacaaagaacaaaacagaacatcaagagtcttagtgatttattcaagtcacatgagttcaatgagtagggaactgcatcaagagacagcttccagttaattttatgaaccttatatgcattgcccaatatgagtgttcaaccccatggttccctgttttttttgggttttttttttttttgtcttttttttgttttgtttttttgtgcaatcaatgacctaaattctagggaagttagggtagaactagagaagacagggaagagcaaaagaaaacaaaatgtgctcagtttggttccgaggaagggtgcggaagctggatccagatggtgggggtttggggaactggataaatcaagagagttgaggtccttggaaaaactgaagacggatgttttcaaggacatagaaacatggctcgtagcaatgctcctggaggcccagcagagaccagcaatacttgatctcggggatcaacattagtgtcttaatgctggttattgtcccaaagtaagtaaggtgtgcagtgttcaagatctgtcccattccaatgatgaggaaaccaaggaccaacaagaggtgtgcattttagagcccctccccatcccaggccaatgaccacaaaaccgattctgtcccccttcccccacaggtagtgcctatgctcctgatcctcccccaatgggacaaggacaggccatttgacccaagcctgttcctcaagagattgacaataaaaatgcccacattttaaatgtgtacatgctacaattttctgattataaaatcaatacaagcttatttgaaaagaacttggatctgctggtatgtgcacatcctttcttctgcaatgaatcaaaggatttattaccaatggtttcatctgggaagattgtaggtgagaaggaagattttggattttgtttttgagctgttttaaattgtgtgtgtgtgtgtgtgtgtgcatgtgtatgtgtcaaaaagatatctgggaaatgggattgtagaccacttcgttttgtcttattatggtgtcatctgtgtctccatagtaagagagagaaagaggaaaaggagtaggttaataatcaatcttaaataatttgaaaactaaagaaaatcaaaatcaacagtaatcataccatctagatctaaaggctcatatcattttagcataccttcatgctgaaataatgaggattattctatatctaaattctaaattattcttttatttatccttattttatgttatgccacaaataattttacatatcattaaatatgcttcagaagcatccacctaatggctgtagaggggccttcctagaaaataactttttatctataaatttcatgttcattgagcacttcctaggtgtctcctgccaagcacagcttccatggcgagggttagatgacacacaccatggcacaatgtgtaaccagatggtttgatgccagagactatgtgcttaaccactttacttctacatggagcatggtttcttaagccaaccttcctctgtagcacatgtacattgttcccaattcgtcactattgaacaaccctgagatgtacatctttgtccatagatctttacatctctgagtacttccctaagtgaacacttcacaaaagagttgtttgactcataagaataaaaatgtttaaggctcttgatgcatttccctaaggaacccacttagcatctccacaacagggtttgagaaggtaaaaattagaactctttttttatttatttgtgacttatttcattacagttgagctgatttttcagtttattagccatttacatttcttagtagtcaacttattgttttatgttaactcacctcactgatacagtaataaatttggtgttcctttagtgtaggtatgggaaatttcttcaaaaatcaacaatattcttgtctggaacactgaattattttctagaatgcagatgcattgtcgacttatatgagtgctcgtcctggaaggaaacagatggtgccctgaacggggataaccgaggagagtttattatagggagcatttacaagggtgtgagcagggttaaggagacccagaagagttggtgcagcatccgggggctggcaacacagaggagccattacctcccctcagtttaaaggggagggaagagcctggagagagtagctgtggttgtcagagaagcactaggcagggcaggatgcagccaaccctcagaaggtaatactctggtgtcctcatctcttccacctcagggtgcagggtagaattgctacactatctcccatgggtctcatggtaaagcaataacgtctaaacaggaagccattaaggcctctattttgatcaaaaaaacagcctctgtaaatccagacaggatcccaggggaccagcatcccagttcagggcctaagctgtagctccaactggctccgcctcctctgtgtgtttcccttccttgatgcttttaaaggaagttgctgtcggatggaaggcaaaacttaggttttctatggcacagttttcaggaagggcaagtcactctttggctctttgggaaactccctcaccccataccccactcagaccacctccaaatgctctaggctgggtctgccatcaatccctgataacagacacccaagggagatggtgtagcaattccaccctgcaccctgaggctgcttgtctcagcatgcaagaacagcctgtgctgcggcaggaaaagtctcctcgagcctgtgaaagagacgaaggagagcagggcattacatataagccagagtgacttggaagtctgcagcctgtctccttcgaaggaagacagacaacatgtataagaataatggcttacatcaatgggccccaacctctggccacatactaagccaaccatttcatcctcatgacaatccagtgaggtagggactatttttatccccattttacagattagtaaacaagattagtaaacacagagaggttacaacttgctcaagttcgctctggtgccttgagctggtgagatggaggaagtgaaatgcaaagttaggtgggtctgaccccaaacccttcacacacatcttcgtgctgcactctgagggaaacgacatagggcctgggatagaagcctgattcagcttcaaagtattttaaatctctgagcctcagactccctctctattaagaaaattaattttttaaaagccattgattccattaatgccccccccgattgttgtaaagctcataggaactgcctgcatttccccggttatcacatgactgtaatttgcttggttgggtctctgctcacaggtcagctcaaccaagagggttcccctggtaacccatgcaaaacagcagggtctcgcctccctgccccaccacccagacatcctcttacttcttactctattaattttttctcatagcacgtaacactagctggcccattatgtgagtgtgtgtatgtgagtgtgtgcgtgtggtgtatgtagtgtgtggagtgcatgtggagtgcatgtgtggattgtgtgtttacacatgtgtactttttgtttaatgtctgacttcgcctctatatggtgagccccaggacagtagggaccttgcctgactagcccaccagagtgtccccagtaccaaaaatgacactgatacagtatggatatttgtcccctccaaatctcatgttgcaatatgattcccagtgttggaggcagggcctggtgggaggtgtctgggtcatggcctcggatccctcatgaagagcttggtgccttcctggagattatgagtgagttcttgctctatgagtgttcatgagaactgatttttgaaagagccaggcacctctctctcctctctcaccacgtaacacctgctccttttcaccttccaccatgagtggaagctccctgaagccctcaccagaagtagatgccgataccaggctcctggtacagcatgtagaactatgagccaaataaatctgctttcttcataaattactcagcctcaggtattcctttatagcaacgcaagcaatctaagacaggcaccttggcatatgcaaggtgctcaacaaatatttgagaaataaacaagcaaacaacaaatgggtagtgaatgaaattaaactgtatggtacttggcacatactagtcacaaaatgtacttataaaatttattttattagactctgaatgccaggtgacttatgataaatgagttcacataaaatgaacaaatttttgacctatcctaaacaaaacacaagagcccgtatgcggaaggggaatagaagtattccaataacttctttttgagaagagttataacaattgagtataaatttaagttatgagcttcttattagcaaaagcaaggaggtaaaccagatgagatgtcacaattctattagatgcagaaagcagtatactatcacccaatgctaatatcttatcagataccttgggtgaacaggaaggtattatggctccacttggcctcagcagatctgcttgaaagaaatgacacagcatttaaattttgttccatgtggtcgactcagtccactttctcttctttctctacatgcaagcctatataactagttccctttaggaggaaaatgcctggcttccatagttttcccttctacagcagaggtgctgaataggatgagctatgtgcccatttcctaggttgaccagacaccttctgagactgctgtgagatttcctggcagggatcagttcacaaatgtagcatgcctcttcaagagtgagaagactttgagggagatatacctgagagcactcaataattgaaaggcaagaaacaccacaaccagagcagcctcccaaaggcagggacaatctgtccttggaaacagcaaacttactcaaattagaagcctccgtgcgggtgtgtatgaatgttgattcaacccttgttaagcactgaccctcggaggtagctacaagccagagtgtcagctgcccagaagctggaaagaggtcagaacaaatgttccaatgatgtgatgctgtcctgcccctagaaggtgccccggtgcagtgggaggacctttggagcccaccaagcctggattcaaatctgccccctaacttgttagccaattgaccttgaacccttccttgcacattgttcccttcatctgcagaaggtgattgacaccattgccctgtgcagcctatcagctacaaatacaggtctggggtcaggctgcttgggtttgactcctagcttaccgatggggtgtccttgggcaagcaccttgtgttctttcttttattttctcatctataaaatgggtatagacatacctacatcctgtgactatggtaaggaccatatgtactaaaccatgtaaagcctttaacccactgatgatggaggttgcaaattttttctgtgaaaaattggaccttggcgatgaccttgaggagtaggatataaataactcccacaagcttagtgttccaataacggaatactaggtatacatgggttaagacagtgctcttaaggataagatgttacttgttttgattctccaaaatttggggcttggtgtgaggccaaaaacatgtgagtagttggcacagtgccaacacttagtgtttgcatctctttcttgcggaaagccagattcagtccaagccctgcttgggggtgagagtaaggtcccttctgcaaacccaaaaaggggtcccagggacagttggatgaggaattccaggccaaagcttttccttggatgtggcagtaagaacagagtgcactgggaacgggctggccagcgcctgcccccctgggagtcacaggaacagaaataggaagcccgggctggtatttacagtaactcttcagcccctgaccacattgtcttgtctgtggtgcatttattttggggacaagtactgaagtcattgctgcccgaaagtgctccaggcgggcccgcctgtctctgctttcccaggagagccctgaggtgagggaaccagacccacaggcaggcctggaggtgccctgagtctggaaggctgaccgcaggcccggctcaggcccctgccagagaacaggcccaggctccccaagagactttgagaggtgcccccagcaggaagctcagaggaggacgaggcggagggagggatgtcccgccccacccacccacaccctcatctcactttccttttccttcaagggctgccttggcctgccttcctggctgcgagtgctcctctctctccatttcttataattcagcagggaaaaggggaagtggattcttcaaagcctcttcctggccttgatgagcaaatgcatggtcccaggcccgggttctggcctaggcaggcctccattagccgtagcctgcctgaatgacaggcaatcctaaaatgccttcgttcctgatacctttgcttagcagaagcattgagcttccctggaggcaggcctaaggctccacctgtgaacggaggcttgatttcttcaagactgtcctatctgggaggttgctctggccagagccttaggagctacagtgcatgttgtagactatgaggctggctccccctagagttgtccagagcacaaccaaatattgtgtgctcacctctagagcttcatgaagcagaattttataaccactagacctgattatcactttgcaggcttggagagctgacactcctctatcaggttagcatttagcgagtacttcacttaccctaaggtgtgagttcatagtggcttaatccactaacattccttaggggtgtttgtgtattcactggacacaaaaactgtttaatgcccaggtttaaagggcatagctggagaatgctaggcattgtctaagacaagaaagagatgctgaggtccaggagactcccttgtgtctaacagtttattcgagaatagcaaatgcccgcctgtctgtgaccagtgttttcttggagccaagaattatgcctcttgggcattttgaccaccccagaagatatatgccatttttactgaatagaggagaggaagaaaactcagatttatcccctacccactattagccagaagttatgctagcactgtgacaaatgtcatttcatttattttcacaactacccttctgggctgttattatcacctcctggaaacaagtaatgtgaggctgaagggaactaagcatattgccttaagtgacagagcaaataagaggcaaacttgtgatttgaacccatgtctgtgtacacccagagtcagtcctcccctccctcctgccgccatcagatggaatcccatctgtgttctgggtatcagcgtcctctgaggagttcactaaaatgtgcattccagttgaaatctgaatttctaggagtcagtcccagaaatttctatgtaattcctccctgccctcaacaagggattctggtacagaacctggtttgtaaactaacgttttggaagttaggttgacgtttgatagtagaaataatctcactagcctagggaattcccacatctttgttcatgcaaaggaggatgtcttttgtcttccatccttgaaggcccaattctaatttaaccttctccaggaagccttcttggactgtttatccagcatgtggtatctcctctgtttcctacaattatctccttgtgcctctctaatgcactaaccactgcatgccttggacaggctatctgcatgcttttacctttcctagacttgaaactcctcctggacaaacctggctttctcatattagttttcatccattcacactcattatcatggaggatgccagaaacctggacagagccctagatgtaaatcaaaaagcaagcattgaaatgagttatgttggatagaatgatcaaggaactttattagaaacctatatctagatggcaaacctgcagattcctcaaaatcctcagctgcttctggctaatttgacttttatcacccaaatccctctaccagaaataatctctctctccaatatatccacctggtgaacttctcttgacacttttcaatcgtcatctccttgcaaaatcattcccactcagagcagcatttactacacctgcttctgggaaagctctgctatgctaggacccaccagaggatatcctatactttattgtatgcctttccctctgggctgcaagcctctgcaggacagaattaggccttactcatccatcttattcattcctagggccttagtgtttggacaggcacatattagtagctcatgagaagaatgaataaatgaatgaatgagtgaatgaatggaaaaataacagtagcaagtctgggtaacatctcaacagatgggtcagtttttctctctagagtcagtgtttctacaagaacataaacaaagggcagccagctcgctaccaagacccggctccacagattttcctgagagtcatcaggtagccctgggtgaaagaagaaagtccctaagatcagctccctctctacctgccagaggtgttcccaatacctaagacaaagccagggacatgatagatcgttcaaccttacctcctcccacaaggtctctctttcatagtgtttgcctactggagaaatttctcgaagtggatcctggagtgtcacaagagcccttcacaaagccattcctacaacaaaacgtggcctggcatggagctctccctccttgcttcttgtcccagagtctacgggcatcagaaagtgatatgcagggagatcccaggggcttcatcagcacgttcagagccaagtcacaggggtcaatgtttttccccatttctgctcataatcagtaacaaatgcagccatgactctgaacttgcttttctagtactttttaaaaagacctttagccacataatttttattagctctttcttatgtttttgtcatttaacaataagaaaattcccacaaattgaagccagacatgtttacatgggctatcaaaagccactatacttttatcaggttcatctttatttattcagtgtccttagctcactagtcatgggttttcagtgtctccttgttgttttgaaagccagaagatgctggcatatggtacaagttgattctccactatgcccatatgcctaaaacccctagaaagttctttgttagggagagtaggagagacatgtgaaatgaaaatctctgttccatttgcatgtattcaattgaatgtgccatcctgtacatataattaagccctgatatatatcataattatgaaactggcacaattttgtatctcattaaagtggcgtgattagaacaatagaatgtacgccgtacacctccctcctttcaggtataaaccaggccaggtttctatggtgtcttggagccttttacataatccgtctatcacagagaggacatgggctcctggaaaccacttctgatgtacagtcactgacacctactcaagctgggaccatgcccacctacttggtgctcagactcagactcaaccattcctctccatcccaggctcagtgaggagaaaaatcaatattcctaagtgggaaaagacccaataagttgctgaaaaagttacttccatttatatgtttgcttttaagtggtcctctttggggcagttaaatggcaaagtggccggagcacagaagaggtggcagccagcccagctcccctctcactaccttgcaaccccagaaaagcaaataacctctccaaaccttgcttccctgtttattagtatttatttatttgattttcttaagtttgccctttgtggtaagaaatcacctcagggcacaggcacaagagagtaacaattcattaaactacatacaactgagctgagatggctgacagcctcgaagtaagagacagccagacaagccttttttaaagctttggccccctaacttgccagaactaccgtaggagtccaagaacgcagcaaggaagcactcactagatagggagagaggctccagctcccagagatcttgggaggcgttagcagcagtgcccaggcaggctgaccatgctctaggagcaaagctcatctcaaaaatgtggaaggttggccgggtgcggcggctcacgcctgtgatcccagcactttgggaggccaaggcaggcggatcatgaggtcaggagatcgagaccatcctggctaacacggtgaaaccccatctctactaaaaatacaaaaaaaaatagccgggcatggtggcagttgcctgtactcccagctactcaggaggctgaggcaggagaatggcgtgaacccaggaggcagagcttgcagtgagcaagatcgcgccaccgcactccagcctgggtgacagagcgagactccgtctcaaaaaaaaaaaaaagtgtggaaggttctccttagctttaaaggcagtgtgggagctactgagaatctagaagaaaatctggttgagaactgactcaatcaagcaaggtctgggcactgtcaacaagagtgaccctgctcagaggcaggccagaacccccactgggtgttaaaaagaggcagaggagctcactctccctgagaattacaattgtccagcaaaggaaaatgaagtgataagctccatccccaggggaatccaagcagagatggagacctgctatgttccaggaaccatgccagggatctgcataaaattcccagggaaccagatcaccgaagttaggaggaaccatgccaagcaggtgagatacagctcagtctaacactaattcacacaacgccttctacatagaaacattttttcaagactcctttgataaagcctactgcatacgttccacggccctctgtcttttccactggacaacatatcttagatatcattctatgtccatccagtaatggggtcttcattcttttcaatggctacaattagaagcatctatcaatgtatcactttttacattgagtttccagtgatgtgcattaaggttgtttctagtgatctgttatcacaatctttgtatatatgtcacatgaaagtgtatctttaggtcacatttccataagtgaaaacactaggtcaaagagaatatgcctatggaatactgatggatacattgcctggagtgcagtggcaccatctcagctcactgtagcctcaacctcctgggcttaaatgatcctcccacctcaacctcctgaacagctgggactacaggtgtgtgccacaacacccggctttttttttttttttttttttgtagagatgaagtctcaccatgttgtcccagctggtctcaaacttctgggctcaagagatccttccacctcagcctcccaaagtgctgggattataggcatgagccactgtgcccagcctggttctttggctgtacatgccctcttcccctaaaagtctctccaggttatcaactcatatagtcagagggctgcactccccagatgaaacataaatctctgtttatggaagcccatgaacacattctgaatacttaagctcaagagaacaaagcctgaagagggaatgtctctggtctgaagtccaccttctactttcccatttctttctgtagggtctgtctcttcttcatactattcttatccatagcacccagtcctttcccttcctgaagatgcaaccctagacttaaccactagacaaacccagcagaacatattgtcccagtatccgtataagatctatacatatggtgcttcattctcggcatttttctctctctaatcactactgccttctaaagaaaatgtggtatgctgtttaacaaaaggctcatgttatgctgagcatgttgataagtttggatagacaaatattggccaaagatggagctgaagctggaaagagccaatacacaataaagccagaggaatttggagattccaagagcaacccatgaaagaggcgataaggaagagaggtagggaagggggaaaggaatcaaagagccatcaagatatcaggaggttgggagttgtgttgtctggggaacaggccagtgatgcttctccagaggtcctgggacccaaggacatttcaaacaaggaggttacctaatgtttactctgaagcagctgtgaagctgagatgtaggtgctatcttggtattcctaattgccaagccatcgttgaagtctaaagagttattacttctgtatgcgtgtaaggcaggggaatagacaatcaaggaaggagctgaccatgcctgggttaatatggcatggatcagtaagtgctctttcagaggtgaacctcagggcccaagataaccatggaaatactagcttatggggattcccactcttagcaaggacctccattgatcaagaggtccagagagtagagatttcacctgatctctggaccaaattatattgcacatttctgcacctttctccatgagggtaggccaagatggctattctcatcaccacaactcttctttcaggttgccacatggccttctccttcacttcaatcaggtctctgttctaacagaaaatcattcctgatcacctaactacagccataccccctgccccaccttctccaccccctaaccctgtcacctagcattgtatatttgtttatccccttattgttttcctccctccctagaacataagccctgtaataatgggaaacttctcacctttgtcttcttggtccccattacctagaactatgtctagcacagagtaggtactcagtaaatatctgtagaatttattaagcaagccaagaatgactggagtacataaacatgaaaacatttggacgttgtttaaaactaagcagattactatgttgagtgtctcgatgtagctgagaaaacaactatttcataaggaacagagtgaaataaaagtcgaagggtttaaatttttttaattagtccttttattctcatgttttgcagactaatagcaaccacggacttagacacatagaaggattttatgaattgcacatctctcagcagggtctgactgcctgcatggacagggagggtgagtcccagtccagataaccatgaacatccatgagtaattatgaccaagatcctattaccaagccaaaccttgcactaggagttaggcatgtgttactgaggtcagcagttggctcttctgtccactgttttgtgccagcccagacaacttaatgctctaccagtgattatacaaattgtgctctcactttttttttcaattacagaagtagagaacatgtcatgatccatacggagaaggaacagagcactgagtttaatccaagagttgtctgcatttccatcatcaaactattacttttccactcatcctgacccaccaccattctcccactctgtgttcagaacagccatcactgcagagtaagatgccattagctagccattgaggtcattagctgcatccacacagaagagcagggaggccaaaggcagcctttggaaatcatactcaagctaccaaagtgaagagaaagcccctggagattcaggggaacaggatctctggcccaaataacccacagctacacgaagagatgcaaggaactgagcagctacttcatgatgtaagacatgtagatgaattatctaaattactcagagtacctgtctacacagcctcagcttacttgagaattgttcttccaggcttcattgaagtcatgaaataaataaaaagccatggaacataaataaatatcatagaaacccctcccaatatatggttgctctccttagagggatggtgataaaatcaagtctgcattcctttatagcatgcatcagtgttaacaacccagcattgtttaagtgaatttgacacatatctgtgcaaataaattaatactctcactttgactgatttttggcagaaacaaacaggatgccatgccaatttatgagttgacctgttacaagagcccttctgaaaataataaaataaaagccatgcaaagtacttcaatatatcttaacaccaaaattaaagaagtcagcttttctttttccttttctctctgttcacctaaagtcctctgacctgttaaactgtgtaatacaaatgtgctagtgatagcagttgtgagaggaagaataaaggtaacaggaaatgggcagggagcaggcaggagatgcatgtaacaatttatcaagggaagagaatgacacctcattgtctatattaagaagagctagaaataaatcaataaaccatttatttattcttcctgaacatccaacatccaatattatagcataacatatatctttccacatgtccacactaccttttttaaagagtagagtcaaaattaaccaaatagccaatttataaaaacaaaagcgttgagagtgacaaatttgatcaccttttcctatcacttcagttgattaaatattatgttctgctttttgattatttagtctataaacaaaaaacataaatacagaagtcaatgaatttttgtctatttataagtaactatccacgtccatagcttcaggaagttttctcatgctccttactgggcaatatccacctcctaccccagagtaactcctttcacctttgtgaaagggtgagagtgacagcggtgttgttgtgtaaggtatgattccaattatataaatttcaagtaagaggaaaattaaacaaaagtgaaagaaggtgacttctttagatattagcaattttactacctttggatattgataaataccttgacctataagattaatacagtttaattataatctataggattcagatacttatcttaatattaatatttttagattgttagctatctcttgagcttgagtttttagatattagtaattttcctcattctcaaattttatattactggaatcatacattatgttctctcttgtgtctgtcttctttagcgcaatatggtatttataagatccatccattttgtggcatatatccttagtttactaatttttattgctgtgtagtattctaccatatgaacacaccacagtctgtttattttcctgctgatgagtatttggggctattatgaaacggctgctgtgaacattcttgtacaagtcttttttgtgaacatgtacctatgtatgaatttctcttgggaatgatttctctagttcataggataggcagatatttaactttattcaaaaaagccacagagttctgcaaggaggttgtaccatgctgtcatttgcttttaaaataactacgttttgaccaaatacaacttatatccacatttcttgtttccttacctcctgtgaatagtttattcatggacatacagatgttggggatggcaggataccatgaaagaacacaacaggctttggaatgaacttcagataagcttcaaaactcaatctccccactcactagtttacagacttgaatcaaaattttacttttaggccaggtgggtggctcatggttgtaatcccaacactttgggaggccgaggtggaaagattgcttaaattcaggaattcaagacaaatctgggcaacagaatgagacccccatctctaaaaaaaaaaaaaaattggctgggcgcggtggctcaagcctgtaatcccagcactttgggaggccgaggcgggcggataacgaggtcaggagatcgagaccatcctggctaacacggtgaaaccccgtctctactaaaaatacaaaaaattagccaggcatggtggcggccgcctgtagtcccagctattcgggaggctgaggcaggaaaatggtgtgaacctgggaggcggagcttgcagtgagcccagatcgcaccactgcactccagcctgggagacagagtgagactctgtctcaaaaaaaaaaaaaaaaaattcaaattagccaagtgtggtggcatacacctgtagttccagctacttggaaggctgagatgggaaaatcacttggacctggaaagtcaaggctgcaatgagccaagatcatgccactgcactccattctgggcaacaaagtgagaccctgtctcaaaaatatatatatatagattatttttaaacatgtcagtctcagtatttctttgtaaaatagcaacattatctattactctataggcttgctgtaagaatgaagtgaggtgagacaggtgaaaatatctagcacaggttcagccatgtggcaggcactggataaaagcaaattcccaagtctccctgcattccctgagcttgacgagcatctttgctttggggtgttaagaaattctctctctctttctctctctctctctctctctctctcctaggccccagagactggggagcaaggaggtcaggaaaagaaagaccctgcagaatggaaggtcaagggaccggatgaggatgaaaatccaccctccatggcagaagggaaaagctctatttacagtaggacccagatggaactgatttgttcagagccatcttattcctgagtgtgatatttgtccacatcataaaaccacaggctacaatgtgtctgacattataccaagtgatataaccccttctaatgatattataataaatcccaaatgaggcagccatcactgggcagccttttcaaagtgttcctgaaatagtttttacagaacaagggatctgcatgccaaatgcagaggctcacatgaggccagaggagttagctcaggcatacacatgaacacaactgtggcttagttcttggctgggaactttttctttctgtattaatctattggtttttatgaaagtcaaaatgttttttttttttacttttttatatgaaggatgaacttggatattttctaagtgcaataaaatgtcccccagggtgctttttttattattattctttaaatcagcagtttttgtgcctcttcattagtacaagtcaacgacctttcatcttggcttcacctccaagaaagctgaccacacttcctgccatcctggtggtagaagcttgtttttctctgttgttttgctaacatgcataggtatatttctgagataccatgtgatctgcttccacaagcatagggagcttgctgactcaggaaccattgaatttttttctaggacaaacgtgtagccctttctgcccttaaaggcaagaaccgcaggaaatcatgtgtctttactaatagggttgcatacaccatcctcctggactgtgctcttagaattagtaggatctggaacaaaaaggagtatctctcacgatcaccagtaccccaccactaccataaccagcgtcaccatttccatgactggattcacaacaacaccactgttactctcaccctcgtcacttcccttgcctgtctttcccacataattattcttctggccattcccactgcagtggataatctattgtctgcatcttcccaacacacctctttccttccctttccccatgtcatgtggttccatcactggtccaaaatttgagcccaagatacgaatacatctgttttactgatattgggaaagactctttttttattctgtcactggaatcacaaggctggtctgggtaagtctaaaattgctagagattactaattgccaacaggagaaaaagagcttatttaacatgaaatatacaccgaagggagcaaatcagaaaagagggggaaaaaaagagagagaagctcttttaaaattgttgagccacctggattcagccatgcccatagttttagttatttaaaatgttaattgttttgcttacactgctttgaattgggtttcttttggcataaaaatgaaaggatttgactaaaaccaccctccctgttacctggttcatatttcccacctctattccaactacactccagcttggcatcccatatcaaagtgtttgctggcaagccagggcctggggttgagattctaagggataactatgatctcctacctaagtaagcctaaagatgaagctacatttcttaagggaaagcaagtccttcatgccaaggagactaaacacaaacttcaagcctggaacaattaggataacaccaagtttaaaacaagagtaaaagacctgagataattgttcccgacactaacagagtacaggaaatttcctttatggactagcattttggttagtgaagataggagggtgacttagcaaatacaaaccaagatggaaggtaccactttcaccagcatcacagtccaccaagtatcaacagcatcatggtggctgtcttgcatttcatcttttactgggcatttagaattcagcagatacaaaaagggcctctactttgcaggagtatatattcccacagggtggaaatacagaaagacaaattcaacaaataaactttcacaagcaacaaaaagctatttgtccccaaaagagtggctaagatacgaggtgaacattaatatacatttggagatgtttgggtctttcttttcataggattggccatctttagaaggcaattattttaaaatagcattctgtttcctctggtggtacatttctacaccttccacaatggtactgcttttcaatgctttaaaaaccacagtagaaacacaaagaaggatatgtatgcattctcattttcttgtaccttcctccccaaaatcactttcaccaccattctcatcacttctactaccactagaatggcacaatcctgggacataggctgggaagaatgatacatcttttctcataactgataatgcttgctgataacatgtactctcttcctggttttaaaactaatgtatgtcaattatgtatttgttaaatacatttgtttacaagtagcaaaaaccaactgaagacaacataagccttgaaggggcctatgatagaaggccataggagttacttgagaacctaaggtgcaggctccagccagtcctccaaacagactggacccaggaagtcccagatatgccccttctttctgcttctctcagagtcttttgctccaatcttctctcattctatgcactagctttctcctagcagttcccagaggatccagagcctagacagccaaagcattgaaaaccactgtgaaagatttagaaatgtaccaccagaggaaacaaaatgctattttaaaataattgccttctaaagatggccaaccctatgaaaagaaagacccaaatagctccatttcattttcttctgggtgctactaatggaaagcagcctagtacggtggatgagagctgactccacattctgctagctgcatgactttgggtaagctttgccccttgcaaaaataaaaagaaataaggccctcttcagaacaatgttcatccatggaaaacactctgtgagcaggggctaacataattattaatacaaaaggggtagatgaccagttcttttgattgaaaacacgctgaaggattgtggacattcaaagataaggcagaagatacctttaaaattaggaatcagatattatagactcactccaattaacaaagagagaagaattccaagtttcccagaacaaactgggaggagagaaacggagagagagaaaagtagtatggcaagagaaggaagcttaacatggtatagtgttacccatgtggagagccaaatggactttgaataacaggaatctaatacaagggatcttaatccagggcccatggatcccaattgatatggagataaaattcagggagtccttgaactgagttgggggaaaaattacagcttagtttcaccaacctccaactaaaaattaacattttcttcaattataaatgtaggcaacacatcacaatagttattggtaacttttgtggctttgcaatcaatagaaatcacagatggtctcatgtcatattgtagttgttgaatacatttcaagatatcatttatacttatcattactttaatattatactcaatttctgtctaacctgtgtatcatgttactgaatgcattattaataaagaagcactttacatcactgtattaccagtttgctttttcttaaatatttgataactttatttcaacataattcattttctttataatcctgtacattttattgcatgaatttaaaaacataatatttgaaagggtctatagttttcacaaaactgccaatagggtccatgaaaacaaaaaagaaaatctttaagtatctctgatataatataggatgtattcatcttttatatggtatatgataataacccttctcttaagccatagatctttagtaagagtctagtatggtacatgcaagagattcatattccagattgtttgaaggaggactggaggtagaaataaaagagaaggaactatgccccatgcattggttaagctaccagatcagagatataagaaccacacactttgggaggccaaggtgggaggatcgcttgaggctcggagttcgagaccagcctgggcaacgtagtgagaccctgtctctacaaaaataatttaaacacacacacacacacacacacacacacacacacacacacacacacacacaaaagagagaatggaataatggaattctaaagataagaagtcactatcagaggtgatgatgagaatgcaagtcctcaaggatccacacaactcattaggaagatgtggactttccacaggacatgggatggcagttaaaatccgcactgtctaactcaaaagtggcaggttggccccaaactgacacctgtggctttaataatataaagaccaccagtaacccaagcaccacccagaaataattaccattattatgctcatataggtcttccagttatttttctgtatatgcatacatgtatggtgttgtattcatatgaagaaaagtttattgtattaacatatatgaatacaatcaattttcaaaactagactcaatgaaagcacacaaatcttactttttaaactttgtcatgcccaaaatataatttttgtggttatatcatgtttcatcatatggagatgccatctgctgtcactaaatcctctaatatttgacatttacattgtgtttaatatttcacttataaataatgctatacagaaaaattcttatacataatttttattaaactgattatttccttagaataaactccaagttatagaaaaattaggtcaaagtctactaacactttaccactcatgaaattcattgccaaatcattttttgttacaatgttaatagcctcatcggcaatgtgtaaaaaactcactttgccatctttttcatcactgcatattatccttttttaaaatattattttttgtttttaattataaggcatgtttgtagctaacttggcaaagttgtctgcaatagtacttctcattgctgcacgcacccctcctttgcaatttgacgttgctgctccttctatcaagttgaatgacatgacaggaaacagaaacaagtgtctcagctagggtcctctagatcaaccggcccccagcaaatccaccagctgactgcaatagaattgtgtaactgtgggcaagaccaacagaagaaacacccagctgagcacagcccaaattattggccctcagagtcatgagtcaatagaatggttgttattttagccactaagttttgggttgatttcttacatagcagtagataactgatataatgttcacttttgtcataaaaatgtatattaaattttagggaaaagtagtaaaatgaatccagtattccaccatccaacatagaagagaccactgctaacaatttgatgtattttattcccatctcttttatgtcagtatgcatgtactatatggatatcagaactataaactaaccttgcttttaaagattgttacaaaaattctacaagcacaccagcaaatgtaattcattaaaatattaaaaacagttatttaaaatcactaataaagagattatttaatgctattaatgagagctatttaatgctattatttaatgatacattacaaatatatgtatcaggtcaatgaaagtgcaattatctggataaatattaataagtaattggtaagtttgatgtccattttttaggaaaaaaaatcatagaatataaggaataggaaaattcaaacctaatatgacatgattaaaatgtctaccttgaaagcaatagtcaattttatacctaatggcactatataagcggcattgctattagaagtaggagcaagtcaagaatgttccctacaatatcatcactaataattgctctggaaattctagttaaagcaataaaacaagaagaacattgaaatgtaactattagaaaaaagaaaatgaatttatgaacacttactcatgacattaccacacatctcaaatcctaagacaatcaaataaaaatgtgttaatttgaagattgagtataagggcttgatataaaataaatatacattttttcaaaattgcaataataacatattagaaaactaatggaaatctatcatctttgtaactttaaaaatatttaatacctcctatatgtaatttaaaatataaatcatctagaaataagctaattactaaatgtggaaaaaaaagaatgagcttacataactgatgacaaagagattgtctattaaattatggtgtgtccataagtaatactacccagtcattaaaaatcgtgtttttgaagaatgtttaaaaacttgtcaaaaagttgtaatatagggttaggaaaagattcatgatacaaaatactatatgcaatatcatctcaaatgtgtgtgtgtctctgtcaacatctgtctctgcttctaaaaagaggtcaatagaaagagacctgaagacaagctgagctgttgctctggctccctcatctcagccaatggcttgttccccaaagctgcccccaagaccacagcctggtgccaacgatgcgtgacatcctctattctactttggaagagaaccagcctaacaagcctctacagtccctgtcacagatggagttctttacagcagagatgagcacctggccttgggaaaccagagaaacaggtcaactgaatgggtcaccaccatcagtgttctgtaagcgtgagaactcattcttcttcagccttcattgtgcctggagatcatcatcaccatcaccccatggtcatcaacatgcttgggcttcccaaaaagaagcccaaggctatatatccaagcagattggactatttgctaaagatgagtctaactgattcaacataggtatgcttccccttgctgagaaactgaggcatctatgacataaataaggtaggtgaacaaagcccactgaaagtcagattgactggtgttcaaatcctggttctactacttcccagctctgggatttggggcatgttactaaatctctatgaacctcactttctacattgtagatgtaattagtaataatatgtaccttacaaggctggtgtgagaattaaagaggatatagcatcgcaccacttatttcaaggtaataaatttaccttggtctccaaaaaggtaaaaaagtgaacgagagcttgggcttctaataaaaagactgttgttggaggaaactcagactcaccatgagtcacttcaaatgtgctgaggctgtggaactgcagaggctatcagtgcaatgtgaatggtacaaagttgggtcccaaacacagggctggaagtccaccagtatctcactgcccatgatgggtaggattgccaggagtagcaaataagaacacagggcagttagattttatttctaataggcaatgaattattaaaatgtggggtataaaagcatgtcccgaatgcataagtatgtatttttcttctgttcattgatacatcccagacccccagactatgcctgacatgtagaagacacttaataaatatttctctaccatgaacaaatttctgaatatgtaggcaggaccccacgaacggtatgaaataaaagatttataataggaattagccctaatatgactgttggagctggtggaaaagtgtacagaaggctatagactctgcatctggtggtggatctgaagttgctacaggctagcagggttggcaatcaggatatcaaatgatgtgaagaagaggagaggaaggaactgggatccacatctctctctctccatgtctaaccttgacaactggtaactttcagaagaagcagacaccatttgtcatagagctgcacatatacctgaaccaggctcagagaaactgatcaacaagatccagtggaaggagctgatcagcaaaatcatacaagggctgtagcagtgtgtggagccctacactttccatgattgcgttaatgatcttcagagtaaaatgagagctgcttcctttccaccttcctcgtctcaggtaaatttctcttgtggccaaccctaacctagaaccatacaaggaggggaatgtggggaaacatagttccatctttgctaaattggcacagttcaaaaccatcaccatctaccctttgctcaacttggcatccgtgcataactcttttaataatacccaaataaagacaccagcaaagtcatatttctgcttaacatgatccaactattcttcaaacagttgaaaacatgctatcaccccaaaagaggatacaaagtcccacatgtcactttagccatctctgggtaatgttcattcatcttgcagctaagccacacctagtcacacccttttgatattctgtaagttaaatgcagagttacaaggtttacttctcttaatgtgtcttgcatttgatggagagagaatgagagtggagaaaaagaaaagacttggttaatacaaatataattatatcaaaataatgaagaaatattcataattactataggccttatttcttcaactggtcacgtggccatggctggtagtcctggtgcactcctaccatccttttcacactccctttgcaatgagcaggtagcctggctcatcatgctttgttgcctgataaagtgacccaaagcttcattcctgaaggatctgggttgtcagctgtcccgcctgtatttggtcatggtggtttttcaacttttatcaccagacttggaaatactaatgggtgccccagggaatgccctacattccagacatactccacttacccatattacgtagtagcaacccagtcactccttggtattcaggatcagtcaccctagccagcacagtaactcccttctttgtgggtccactcagggacatgaggaggccaaggaggccaggaagcagtctcaacttccctctaattaactgttattgtgccccttttgggggagcacttctcccctgggggtctaagtcttcttggttaggaaaggttaggctgggtacggtggctcacacctgtaatcccagcactttgggaggccaagacaggtggatcacttgaggccagtagttgaagaccagcttggtcaacatggcgaaactccatctctactaaaaacacaaaaattagccaggcatggtggcaggtacctgtaatcccagctactcaggaagctgaagcaggagaatcacttggatccaggaggcagaggttgcgatgggctgagattgtgccactgcactccagtctgggtgatagagtgagacttcatctcaaaaaatgaggaaagacaggttaaattcacagggaaggatgcaaaaactttgctctcagactactagggtaatagtaagaggagttcattcccagacctatgaaacctggctgtggcgaaaccatcactgattattccagccccacaaagtgctaccacccagtcagtgccataaagtctccaagtggcttattccagaatcctatcagccacttgctttgggctgatggaggacattgaaaggccagtgaatttaatgagcatgagccaatggctgatcttcatttgctgtcagatgagtcccctggtcagaagaaatgctcctggaacactgatggtaaagagggccctctgagatccgtggtggtcctggaagcagcatttcaggcagagaaaacaagtctatttctagagtaagtgtcagttcccatgagaacaaagcactgctccttctatgataaaaataattcaatgtaattaccctaccaccaggctgatccccaggggaaaagtgccatattgaggaatcagagtgggtcactcctgttagtaggtaaagcagtgagcagttgtcatagccagagacagcagccttgaggagtgaaagtccatgttgctaagcccatgcaaaacctccatccccgccaccaaagccatttagttgatgaattatagacatacaagtgacagaggaggcaccaagagactcctgagttacatctcgttgttctgtgagcacaagcacaaagcaggaagtaggaaacggggctaataggaatacggaagactcgggactttagagaacaggctgaagtgaccagaatttatgatttcccatgggtgggtcagaagagtcaagataatatcaacatcttcctctgtattctggaagcatctcaaatgagcacagaatctgtaagggattaactgtgtgatctattctgacatcctgctcagcaaatgtgccccagaggagagaacttgccccatccccactcactggtggcaggattttggggggacccagaaagaggctggtacatcagagctcatggagctcccctttggcccatgtcctttgtgatattcatagaccattgatggctccttcataatggacctcccagaacacaaaccaaagcaaagcaaagagttctatacctccctcacttccaccttacccaagcttt
